United States Patent 7,630,836 (POLYNUCLEOTIDES) - sequence listing, part 2

SEQ ID NO: 1 - DNA, 9025608 bp, Streptomyces avermitilis (residues 1,805,123-3,610,244 of 9,025,608)
  misc_feature (4187715): a, t, c, g, other or unknown
acgagcacttgctcggccttcttcgccgccatggacgcacggtagcaaaaaatcgagtttgttgcatcggaattaaatgcatttgcattcaatgcatgcgcatgtactgtcttccctatgacctctccgctcaccacctccgtgtccgggggacgctggacccctcggctgtggggcaccctgctggtgctctgcgccgcgatgttcctggacgcgctggacgtgtcgatggtcggcgtcgccctgccgtccataggctccgaactcgacctctccacctcgacgctccaatggatcgtcagcggctacatcctgggatacggcggactgctcctcctcggcggacgcaccgccgacctgctgggccgccgccaggtcttcctggtggccctgggcgtcttcgcgctcgcctcgctgctcggcggcctcgtcgactcggggccgctgctgatcgccagccgcttcatcaagggcctgagcgccgcgttcaccgcgccggcgggcctgtcgatcatcaccacgaccttcgccgagggcccgctgcgcaatcgcgcgctctccatctacaccacctgcgcggccaccggcttctcgatgggtctcgtgctgtccggactgctcaccgaagccagctggcgcctcaccatgctgctgcccgcgcccatcgcggtgatcgcgctgctcgcgggtctgaagctgctccctcgcagcgaacgcgagaaggaccacaacggctatgacatccccggcgccatcctcggcaccgcgtcgatgctgctgctcgtcttcaccgtcgtggaggcccccgaggccggctgggcgtcggcccgcacgctgctctccttcctcgccgtcgccgccctgctcacggtcttcgtccgggtcgagcggcgatcaccgggtcccctgatccggctcggggtgctgcgctccggcagtcagatccgggcacagctgggcgcgatggcgttcttcggctcgtacgtcggtttccagttcctggtgacgctctacatgcagtcgttgctcggctggtcggcgctgcacaccgcgctcgccttcctgcccgccggcgcactggtcgcgctgtcctccacgaaggtcggggccgtcgtcgaccgcttcggcaccccgcgcctcatcgcggcgggcttcgcgctgatggtcgtcggatacgcgctgttcctgcgcatcagcctcgatccttcgtacgcggcggtcattctgccgacgatgctactgatcggcgcggcctgcgcgctggtcttcccctcgctcaacatccaggccaccaacggtgtggacgaccacgagcagggcatggtctccggcctgctcaacacctcggtgcaggtgggcggcgcgatcttcctggcggtcgtgacggccgtggtcacggcgaacgcgcccgagggctcctccccgcaggcggtgctggacagttaccgccccggtctgatcgtggtgaccgggatcgccctcgcgggcctgctgatcactctcacgggactgcggacgcggcgcacccaggcgtccgtcgtggtcgcggagtcaccccagaaggcgccggaggcggagcgcgtggcagtacacgactagggcctcaacatgccccagggggagcctccgtggtgtgcgtccggcgcggttgaccgcccgccgggcgcacgcctgtttgactcggggtgcgggtccggggatcagcccagccagcccggccgcaccaaccccgactcgtaggccagcaccacgagttgggcccggtcgcgggcacccagcttgaccatcgtccggctgacgtgcgtcttggcggtgaggggactgacgaccaggcggcggccgatctcgtcgttggacagaccgaaaccgaccagcgccatcacctcccgctcccgctcggtgagtccggcgagggagtcggcggccgccggcgccttggagcgggccgcgaactcggagatcagccgccgggtcaccccgggcgagagcagtgcgtcgccctggaccaccgcccttaccgcacgcaggagttcgtccggctcggtgtccttgacgaggaagccggaggcaccggagcggatcgcctcgaagacgtactcgtcgagttcgaaggtggtgagcatgaccaccttgacgtgcccgaggtccgcgtcgtcggtgatccggcgggtcgccgccaggccgtcgaggaacggcatgcggatgtccatcagcacgacgtccgggcgcagttcgcgcaccttgcgcaaggcctcctcgccgtcggcggcctcgccggccacgtcgatgtccggctgtgcgtcgagcagcgccttgaaccccgccctgaccagcgactggtcgtcggcgagcagtacccggatcaccggtcctccttgatctgaagggtctcctcgggcggcgccctgaacggcagtacggcaagcacccggaaaccgccgtcggcgcgcggtcccgcctcgatcgtgccacccagcgcggcggcccgttcgcgcattccggcgagcccgttcccactgccgcccgcgtcgacgccggccgcgggcccgtcgtcgtcgatacggagacgcagtacgccctgggtgccgccctgcgtgctcgcgtgggggtcgacccgagtgccggcccgcgcgtcacctgggaggtcaccgccggtgtcgccccggccgtcgtcgatcagcacgcgcgcgtgccgcgatcccgaatgccgtacgacgttcgtcagtgcctcctggacgatccggaaggcggcgagatcggtgccgggcgcgagcttcggcacctcgccctcgatctcgaccgtcaaccccgcgctcgccgcctgctcgaccagttccgacagccggtcgagcccgggcgccggcgcacgcggcgcttcgtcgggcgtgcgcagggtgtcgagtacgtgccgcacctctcccaacgcctccttgccggccgccttgatgatggtgagcgccgtgcgcgcctgctcggggtcggagtcgagcagcgcgagaccgacgcccgcctgaacgttgatcaccgagatgctgtgcgcgaggacgtcgtgcagttcgcgggcgatccgcagccgctcctcgtcggcgcgccgccgggccgcctgtgcccgctcggcgcgttcgcgggcccactgctcacggcgtagccgtgccagctccgacaccgccatgatcgccaccacccaggtgacgatgacgatctcctgcccccagggggcgggcgcgtccccggagggcggcagccaccggtagagccagtgcgacaccaccacatgtccggcccagagcatgccgaccgcggtccacgcggccctgcggtgcccggcgacaaccgcgctgtagcagccgacggcgacgatgaggaacaccggcccgtacgcatatccggcacccagatacagcatcgcggccgccgccgtaccgaagacgacgggcaccggatggcgatgccgccacagcaggagggccgaaccgaggagcagcagtgcgcgcgcgaaggggtccagcggcgcacggcccccctcctgcacgtgcgcggcgaagtccgagccgacgagtaccaggacggtgagcagcgccgtcgagcgccacggcagacggggaccgcggccacggccctggcgccggtcgtcgacccagcggcgccaccacggtggtccgtgccgccacccctgggcgttcgcgcgctgttcctccatggcgttcacgctagacggcacggggagtgggcggcgtcggccgagcgtggtgatcacgtctactccccggggagtacaggtcggccggggcgcgccctctcccggctaccgcgtggccgacaggtcgtcgatctcggctgcgaagagcgcggccgggtcgaagcccatgcccgtgaagtggccggcgagttccagggacaggacgccgtgcagacgggtccagaaggccagcgccgtgtgcaggaccgcgggcggggcggggtggtcggccgcccatgggcggtggtccgcgaggtgttcgtcgaacgcgtcgccgtgcggggccgcgcccggcgccgccgcacacgcgtcgagcagggtcgacatgatctccgaggcgatcgcggtgacgtcctcgggtgcgtgatagccaggtacgggcgtgccgtagacgaggaagtaccgctgggggtcgccgagtgcccagtcgcgcatcgcgtgcgccagtcctacgaggtcggcgcccgactcggcggcggcgcggaaggcgtccgcgaggctgcggtaggcgtcccggatcagctcggtgatcagttcgtcgcggccggcgaagtagcggtagagcgccgggccgctcatgcccagctgcttggcgatcgcgttcagggacagccctgacgcgcccgcggtggcgatctgctcccaggcccgttccttgatctccgagcgcacctgggcccggtaccgctctcggggactctccttgactccggccatcgtccgcgacgctcccctctgccttcaccgcttcgtctcactcttcgccgcactcttcgtttcaacctatcaccagagatagagccagtaacagagatggaagcaagggcttgacaccatcgcgagcgctagtcattctcgttatagcttctaacgcaagcaagtgactctagacggaggtcgtcatggaaggcgtcatcgcgagcagggaactcctcgaggtcgtgctgcccggcacggtggaaccggaggggcttcagctccggtaccgggcgctaccggccccggaagccgggcagatcctgatcgcgatggaggccaccggcgtctccttcgccgagcagcagatgcgccgcggccggtactacgaccagccgccgttccccttcgtcccgggctacgacctggtcggcaccgtgcgcgcggccggcagcggagtcactcccggcctggtcggcaagcgggtggccgccttgacgaaggtcggtggctgggccagtcatgtggtgatcgacgcggcggacgcggtggaggtgcccgccggcgtcggggcggctgaggcggagacactggtggtcaacggaatcaccgcgtggcagatgctccaccgcaaagcccgggtgcgcgccgggcagacagtcctcgtccatggagccaacggcggcgtgggcacggtcctcgtgcagctcgcgcgcgccgcgggcgtgaaggtgatcggcacggcgtccgcgcgccatcacgacgccctgcgtgaactgggcgtgaccccggtcgactaccgcaccgaggacgtccccggccgggtccgcgaactggctccgaacggggtggacgccgtgttcgaccacgtcggcggacggagcgtgatcgactcctggcggctgctcgcaccgggcggcaccctcgtctcctacggcagcgccgccacccgggacgacacgggctccaagcagtggcccgtactgaagatcctcggccgggtgtggctgtggaacaccctgccgaacggccgtcgcgcgtacttcttcaacgtctgggcgggccgcgccctgagcaagaaccgcttccgcgcccggctgcgcgccgacctcaccgaggtgttcgcggccctccagcgcgacgaggtcaccgccaggatcgccgccaggctcccgctcgcgcgcgtcgccgaagcgatgcggctggcggagtcggggacggtcgccggcaaggtcgtgctgatcccgtagtacgacccgccggacccgggggtgcgacccgcgtgccccgtaccctgccggtctcagggcccctgcttactcccgccgcgcggcggggtcggcccggtgaagaccagacccacgtcgtgggcgagctgggcggcggcgtgccggaagaacggctcacggtcctcgaccaaccggtggaactggccgaacagctcgaagccgaccagcccgaagagcttcgcccaggccgcgacgagcgccacgaccgtcgccggcggaaggtccggcgcgagatcggcggccatccgccgggcctcgggctcgagttcggcgggcagccgcgagccgacgacaccgggtccctggtgcgcgtcgcggacgatgcccatgagaaccaggccgacgcgggacgcggccggcacggtggtgtcgggcgctacgtaaccgggcaccggcgaaccgtagatcagcgcgtactcgtgcggatgagccagcgcccaaccgcgcaccgcctcgcacacggcgacccaccgctgggcatggttcgccgcgtcggaacccttggcgtgcgccgcctcggcggtctcaccgagggagtcgtaggcgtcgatgatgagggcggtcaacaggtcgtcgcggctggggaagtagcggtacaacgcggaggagaccatgcctagctcgcgggcgacggcccgcagcgagagcctggcggcgccttccgcagcgagttgtctgcgcgcctcgtccttgatcgcggcggtcacttcggtccgggctcgggcgcgggctcctcgtgcggtgctcatgccgggcagtgtcccatgctttcggagcagtgcacacagttcggagcagtgcacacagtccggagcagtgctccgggtggagagcagtgcccataactgagagcactgctcttgctttggagcgccgatctcatgcacactcctctcaagcgagagcaccgctctccaaagcgtcgggagtcagcatgtcgtcgtccccgtactacctccagggcagccggttcaccatccgcatgaacggcgtcatcggctggctcgcccgccgcggattcagcctcaagggcacggccgagctctcggtgcgcggccgcaagagcgggcagcagcagcgcatccccgtcaacccgcacccgtacgagggcgccgaatacctggtctcggcccgcggccactcccagtgggtgcgcaacatgcgcgtcgcgggaggcggtgagctgcgggtcggccgcacggtgcgcgcgttcaccgcggtggaacttcccgacgaggagaagctccccgtcctgcgggcctacctcgagaagtggggctgggaggtcaaccagtacttcaagggcgtgacggccaagtcaaccgacgaggagctgatcgcggccgcccccgaccacccggtgttccggatcacggtcaagccgtgatccgggcccggcgtacctgacctacccggcgtaccccgccgcccctgcctgcccgcacccgtcgcaccgccgtaccgctgcgcctaccgatccagcgaggtcaggacacgccccgccatcgggtggctgcggacgagttcgccgagcgaggtggcaccccgggtgatctgcgcgaacgccttccaggcgggcctgaagccggtgagcgccgcgtggaacatgccgggacggcgctcgaacgccgtgagcatgcgcttgccgacgctcatttcgacgcccagccccgccttgatcgcgaaggcgtagttcagggcctggcgccgcgtgtccacggcgtcgtgggcctcggcgatacggaccgcccactcccccgccagccgtcccgaccgcagcgcgaaggagatgccctcccgggtccacggctcgaggagcccggccgcgtcaccgcacaccagcacccgcccgcgcgacagcggcgagtcgtcggcacggcagcgggtcaagtgacctgaggagatgctcggttcgaaaccggcgaggccgagccgggcgatgaagtcctccaagtaccgcttggtggcggcaccttcacctcgcgccgagatcacaccgacggtgagcgtgtcccccttggggaacacccagccgtaactgccgggcatcggcccccagtcgatcaggacccgcccctgccaatcctcggcgacggtctccggcaccgggatctccacctccaggccgaggtcgacctggtcgagcttcacaccgacatgcgcgcctatccggctggcgctgccgtccgccccgacgacggcccgcgcgagcagggaatcgccgccctgaaggacgacggcgaccgtgcggcggtccggtacggcggacccgtgctgctcgacccgcgagaccgtgacacccgtacggagttcggcgcccgccttctgtgcgtgctcgacgagctgctggtcgaactcgggccggttgatcaggccgaacagcatctgcttggagcgacgggtgcgcgtgaaccggccgttgttcgagaacgtgaccgcgtgcacccggtcctggaagggcagctcgaagccgggtggcaacgcgtcacgcgaagggccgatgatgccgccgccgcacgtcttgtaacggggcagctccgccttctcgaggagcaggacactgcgtcccgcgaccgctgccgcataggcggccgaggcgcccgcgggccccgcgccgaccacgacgacatcccaaacctgctgcgcgtcgtccgtcgaagagttctcgctgctcacgatggtctactgctcccgatcaagccgcttgccgcacctgtctcaggcatcctacggcgggcgtcgccgccggcccctgtgggaggatcggcagcgtatgcgccctgcacaccagaacacgcgtacgcaccgcacggacacccgtactcataagtacaacgtcgcacctacaaggagcgtgcccatgtcgtcgaatccggtcgccgagaccgtcgcctccctgatgccgcgggcgaaagcggagctcaccgagctggtggccttcaagtcggtggcggacttcgaccagttcccgaagagccagagcgagggtgccgccaagtgggtcgcggaggcgctgcgcgacgagggcttccaggacgtggcactgctcgacaccccggacggcacacagtcggtgtacgggttcctgcccggcccggcgggcgcgaagaccgtgctgctgtacgcgcactacgacgtgcagccgccgctggacgagacggcctgggtcagcccgcccttcgagctgaccgagcgcgacggccgctggtacgggcgcggttccgccgactgcaagggcggcgtcgtcatgcacctgctggccctgcgtgcgctcaaagcgaacggtggcgttccggtgaacgtcaaggtgatcgccgagggctcggaggagcagggtaccggtggtctcgagcggtacgccgagcagcaccccgagttgctgaccgccgacgccatcgtcatcggcgacgcgggcaacttccgggtgggtcagccgacggtcacgtcgacgctgcgcggtatgacgctcgtccgcgtgaaggtcgacacgctcgcaggcaacctgcactcggggcagttcggcggcgcggcgcccgatgcgctgggcgcgctgatccgcgtactggactcgctgcgggctgaggacggatcgaccaccgtcgacgggctgaccggcgacgcccggtgggaggggctgcggtacgaggaggagcagttccgcaaggacgccaaggtgctcgacggcgtggagctgatcggttccggcgccgtcgccgaccgcatctgggcgcgtccggccgtcaccgtgctcggcatcgactgcccgccggtcgtcggggcgaccccgtccgtgcaggccggcgcccgggcgctggtgagtcttcgggtgccgccgggcgtggacgcggccgaggcggccaagctgctccaggcccacctggaggcgcacacaccgtggggcgcgcgggtgagcacggagcagatcggccagggccaggcgttccgtgcggacaccaccagcccggcgtacgcggcgatggccgaggcgatgtcggtcgcctacccgggccaggagatgcagtacgcgggccagggcggctccatcccgctgtgcaacacgctcgcctccctgtacccgcaggcggagatcctgctgatcggcctgagcgagccggaggcgcagatccacgccgtgaacgagagcgtgtctccggaggagctggagcggctctcggtggcggaggccctgttcctgcgcaactacgcggcggtctgagccagtctgcccacagcagagggccctcccccaccgggcgatggccctctacgttcgcctcatgcaggtcatcgaagtcctctcggggcgtaccgcactccatctgctgcgcttcgccgtcggccaggcgtatctctggtgcgacggcgacgagtcgacgctgatcgatgcgggtgcggtcggctcggccgcctcgatcgtccaggcgctcaccggcatcgggcgtcgccccgaggacgtacgacgcatcgtgctgacccacttccacgaggaccacgcgggcggggcgggcgagttcgcggcgttgagcggcgctcgtgtgtcggcccaccggctggacgcgccggtcgtacggggcgagctccccggaccgccgccggtgttcgaggactgggagcgaccgatccatgccggggtgagcaagctcctgccggagcggtcccccgaccaggtgcggcccgaggccgtcgccgaactgtccgacggcgatgtcctggacttcggcggtggcgcacgcgtcgtccacgccccggggcacacggccgggagtgtcgccttccatctccccgagcacggcgtgctgttcacgggagacgccgtcgcggcctcgcccgtcgacggccgcgtcatgctcggcgtgttcaacgtcgaccgggcccaggccgtcgactcgttccgccgactggcatcactcgacgcggacatcgcctgcttcggccacggcggtccggtggtcggcgctgccgctggggcgctgcgcgcgtcggcgcggacgtacgacgaggtgtagcggtcgtcgtccgcggcggacagtcttggtgcggggcggggcggtgcggggcggtgcggcggaccggccgggccgacgaccgggccaccggcacgccccgcgcgagtccgccgggtcggggtcagccgagcgggatcccggcctccagatacagcgccgcaccgcgctcgcgtgcgcgcagcgcccagcggagccgttcgtaccgcacgggcggcagcagcccggccgcctcctcctcggtgacgaagcgccagtcgcgcagttcgggcccgggcagcaccaggcgtccggcctcatggctgtcgaggagccctccgtcgaagaggaagcgcagtccgccgtagcccggcggcacaggcgcttcccagtcgacgacgaggagccggggtacctcgtcgagccggatgccggtctcctcggcgacctcgcgcatgccggcccgtgcgggcgcctcgccgggttcgacgacacctccggggaactcccagccggctttgtaggtggggtcgacgagcagtacccggtcctgttcgtcgaagaggagcacacccgcggcgagggtctcggcggtcggctcgggggtctgcacgatgtcgcacgcgggcgcgtccccggtgcgcacggcctcggcgatccgcagggcggtctcgtacggggtgagggcgctggtgtcgacggggtgggcgtcggcggtgagccaggcggcgagggcggcccggtagggctcgatgtggtcgtacgaccactgccgtacccgcatctcgccgtcagccaggtctgcggggatctcccgctcggctattcgctcccgcaggatcgtttccgccggggcgaggaggacatggcgtacgggaatgcgccgggaggcgaggccaccgaagatctcgtcgcggtactcctgtcgcagcagggtcatcggaaccaccaggacaccaccgagatcggcgagcatcgcggccgcggtgtcgaccacgagccgtcgccagatcggcaggtcctggaagtcgccgacctcggcgaggcgtttgggcggcagcaggtgcgtgagtgcgccgccgatgacctcggggtcgaagagcgcgctgttcgggatcagttcgatcagttcccgtgcggtggtggtcttccccgcaccgaacgcaccgttgatccagacgatcacggttccccctcttctgttggcccccctgtggcttgccctctccaccctgccacggaaaccaggccctgatgagggcgcctcggcgtgtccgacacgccgcggcgccggtgcccccgtccccggggcaccggcgccgcgaccatcggatcccgtcagcctttccgtcccagggcgttgtcgtccacggccaggctgtcgctgttgatggtgtggtcgacggtgctgatcgtgtcgttgacgttcagatcaccgattacgtcgccgtccacggcgtgggacggagtgactgcggcgacgacgaacccggcggcgagggaggcgatggcgagcatgctgcgcttcttcatgcccggttcaactgcggaaccgggcatgagtcacggcccggtccccgtttcggccacactgtcccttcgaggacccgagcgtgactcccgtcgggaagcgtgaccgcgcccgctcccacggccgtgccgcgcaagagattccgccgggacatccgatgtcctgcctcgtccccggatgcgccaggcccctcaacgatggctgtgccacgtccccctcaacgggctgccacctcacacaaccgaacgcgcggcttggatctcactcccatgtgagggcgccgtcaagggttctggcgggatatcgaacaaacactaccgccctcttccaacagagtccgacacgttctaacgtaaaagtgcatggttgacgtgaacatggtgacatcccgcctttagcgcgctcggaggaacgtaacgatgcgtcacccctacgcccgcacaacccgcacaacccgcacaacccgcacaacccgccgaagagtcgtcggagcgctcaccgcaggactgttgtgtacggccgggctcgcggcgccggccctcgccgctcccgccgccggtccggtctcgccccggccggccgacagcctcgccctcaccccgccgatgggcttcaacaactggaactccacgggatgccgaccggagttcaacgaggacatggtcaaggggacagccgacatcttcgtcgagaagggtctcaaggacgccgggtaccagtacgtcaacctggacgattgctgggccctgccggcccgggactcgaacggcaagttggtgccggatcccgctcgattcccgggtggaatcaaggcggttgccgactatgtgcactccaaagggctcaagctcggcatctacaccagcgcgggcaccaagacatgcaacgaagccggtttcccgggcgcgctgggccacgagtacagcgacgcccaacagttcgcggactggggcgtcgactacctcaagtacgacaactgcaacaaccagggtgtcgacgcgaagctccgctacaccacgatgcgtgacgcgctgaaggccacggggcgccccatcgtctacagcctctgcgagtggggcgagaacaagccctgggagtgggcgtcggacgtcggacagctgtggcgtacgaccggggacatcagcgacagttggggctcgatgctgtcgatcctcaagcagaatctgcccctcgcgccgtacgccggtcccggccactggaacgacccggacatgctggaggtcggcaacagcggcatgaccgacaccgagtaccgcacccacttctcgatgtggtcgatcatggccgcgccgctgctcatcggctcggacctgcgcaaggcgtccgccgcgaccttcgacatcctcgacaacaaggaggtcatcgccgtcgaccaggacccgctgggcaagcagggcacggtgctctcctccgagggcggacgctgggccgtcaccaaggagatgaaggacggcagccgggcggtggccctcttcaacgagacggacagcgcacagcggatcaccaccaccgcgcaggccgtaggactgccgaaggcacacgcgtacacgctgcgcgatctgtggcagcacaggagctacaacaccgccggcacgatctcggcgaccgtcccggcgcacgggacggtcctcgtacgggtctcggccgacgccgcatgggccaagaacccgcccgccgtcgaactgggcgtggacggcagcccgttgctggaggcgggcaggacggtcgccctgacctcggcgctcaccgacctcggccgtacgcccgcgaagcgtgtctccgtgacactgagcgggccccgggggtggcgggtgagggcgacctcgccgaccaccgcgggcacggtgccgacaggccgttcgctgcgcacgaagtggaaggtcaccgcgcccgacggcacggccgccggctcgtacgacctgacgctgaaggcgacctaccgctcgccgacgggggtacgcgccgagaccctggtgccgctcgcggcgtccgtggtgccggccccgccctcgggcgtctcctacctcggggacctgccctggatgtcgacgaccaacggctggggcccggtggagcgcaacaccagcaacggtgagagcgccgccggcgacggtcgtccgatcactgtcgacggcgtcgtccacgccaaggggatcggtgtgcacgccgagagcaccatcgcgtactacaccggcaggtcgtgcgagacagtcaccgcggacgtgggggtcgacgacgagcaggacaccaatggcagcgtcaccttcgagatctgggcggacggcaccagagtcgcctcgaccggggtcctgaccaccgcgatgccggcgcgaccgctctcggccgatgtgaccggcgcccaggtggtccggctggtcgtcaccgacggcggcaacggcatcacctcggaccacgcggactgggcggacgccaagctcagctgctgacgtcgggcaaggggccgggagccgtcggcctcagccgctcaccccgacggcggtcgcgctcggcttcctgctgagcgcggccgccgcggcgccgaccagaccggcgtccgtgcccatctgcgcgggcgtcacggtcagccgctgcacgaacgacagggtggcgtagtcccgcagcgcggcccgcagcggcgtgaagaggacatcccccgccttgcccactcccccgccgatgacggcgatgtcgacctcgacgagggtcgcggtcgcggcgatccccgcggccagcgcctgggccgcccgctcgaaggaggccacggccaccgggtcgcccgcccgcgcggcggcggccaccgcggcggccgaggtgtcaccgtcggggcccggctgccagccgccctccagcgcgcggcgcgcgatgttgggtccgctcgcgatgcgctccacgcagccgcgggaaccgcatgggcacaggtcgccgtcgaggtccacgctgatgtgcccgatgtggcccgcgttgccggtggggcccgagtgcaactgcccgccgaggaccaggccaccgccgacgccggtggacacgaccatgcacagcgcgttgtcgtggccgcgagccgcgccctgccagtgctcggccgccgtgatcgccacaccgtcgccgatcagctcgacgggcagccccgccgtggccttgcggacccgctcgaccagcgggtagtcgcgccaccccggcacgttcacggggctcaccgtgcccgcggaggcgtccacggggcccgcgctgccgatgccgacggccgtcgccccgccccacagcgaggagccggtcaactcgcctatgacgtcctcgacggcacccatcacggtgtcgccgtcctcctgcgcgggcgtggcgcgctgggcacgcaacaggatccggccgtggccgtccaccagcgctccggcgatcttggtgccgccgatgtcgagcgcggccacgaggtcggtgtgcatcagtttcagatctcccaatgccgtgtcgtaccggtcccggcacggcgactgccgtcacggttccgggtccgggtccccggccgagagcgggctgaacggtgcgcccctgggggaaggcgcaggccggagttgcgatggacagtctctcccgagtctgacaacgttgtccaggctctatgctcgacgccacatcctcatacaaccccggggcccgacgcatccccgtggacgacaggacaggacagcgcatcgtggcagagaccgcccgcagagccgagaaccgctacggcaaccgtccgaccatgaaggacgtggcggcgcgtgccggtgtcggcctgaagacggtctcccgcgtagtcaacggcgagccgggcgtcacccccgacacggagcgccgcgtccaggaggcgatcgacgcgctgggcttccgccgcaacgacagcgcgcgggtgctgcgcaagggcagcaccgcgagcatcggcctggtcctggaggatctcgccgaccctttctacggccctctcagtcgcgcggtcgaggaggtcgcccgggcccacggcgccctgttgatcaacggttccagcgccgaggacccggaccgcgagcaggagctggcgctggccctgtgcgcacggcgcgtggacgggctcgtcgtcatccccgccggtgacgaccaccgctatctggagcccgagataaaggcgggcgtcgccacggtgttcgtggaccgccccgccggacgcatcgacgccgacgccgtactgtcggacagcttcggcggtgcccgcgccggcgtcgcccatctcatcggccacggccaccgccggatcggcttcatcggtgacatgccccgcatccacaccgccgtcgagcggctgcgcggctaccgggccgcgatggaggacgcgggcataccggtcgaggactcctggatgtccctgggcgtcaccgatcccgagcgggtgcgccgggccgccgagaagatgctgtcgggcccctcccccgtcaccgcggtcttcgcgggcaacaaccgcgtgaccgtcaccgtcgtacgtgtcctcgccgagcacggccgccgcatcgccctcgtcggcttcgacgacttcgaactcgccgacctcctccagccgggcgtcacggtcgtcgcgcaggacgcggccgccctcggccgtacggccgccgagcgcctgttccggcagctggacggctcgctcgtcactcccgagcgcatcgagctcccgacccggctgatcacccgcggctcgggcgagctcccgccggcggactgaaccgccgacggacgagtgcacaccgcggggtgccggccctcgctccggcaccgcgcgcgtccacggaggtacccggccgctcggcccgaggggcccgtgcccgtccctgtcgactccgccgtgcgagggcggggttcggggtcaccggacaggtctacgtcgtgcggtgccgggtgcccgcccacacatcggtgtcgccgccggggcgtcggcagctacttcgcggacgccgtcaggtcgccccgcctgggccccgcgaagccctccaggtcggtccgggtcagaccggtcgcctcggcgacctccgcgacgtcgagggcgccgcagtccaggccgcgcagcagatagccgctgagcgccttggcggtcgcgggctcgtccatgacgtctccgcccgcgcggtcggcgtaccgcgagagccgtgccgccgcctgctcgaagccctcgcggtagaacgcgaacacggccgcgtaccgggtcgggatgtggcccggatgcatgtcccagccctggtagtaggcgcgggccagagcccgccgcgtgagcccgtagtgcagccgccaggcgtcgtggacctgctcggtcgggccgaccggaaggacgttggtggagccgtcacagacgcgcaccccggtaccggcggccgcgacctgcatgatcgccttggcgtggtcggcggccgggtggtcgctggcctggtaggcggcgctgacgccgaggcaggcgctgtagtcgaaggtgccgtagtgcagtccggtggcgcggccctcggcggcctggatcatccgggccacggtcgcggtgccgtcggtggcgaggatggactggctggtctcgatctggatctcgaacccgagccgtcccggttcgagaccgcgggccttctcgaaggcctcgaggagccggaccatcgcggtgacctgctcggcgtacgtcaccttcggcagcgtcaggaccagcccgtcgggcagaccgcccgcttccatcagccccgtcaggaagacgtcgagcgtacgaatgccccggtcgcgtaccggcgcctccatgcacttcatgcggatccccatgtacggggccgccgtgccgttccggtacgcctcggcgatcagccgggccgcacgcgcggcggcctcgtcctcctcggcgtcggggcgcgggccgtagccgtcctcgaagtcgacacgcaggtcctcgatgggctcacgttccagcttggcgcgtacgcggtcgtagaccggcgcggcgagctcctcggcgaggccgagtgcggtggcgaaggaggcggcgtccggggcgtgttcgtcgagcgcggcgagggcgcggtcgccccaggagcggatggtgtcggcggcgaacacgtcaccgggtacgtacaccgtgtggacgggctggcgggtgccggggtctcccgggtagcggcgctccagttccgcgtcgaccggggcgagggtggcgctgattccctcgctgacggcgcccgcgaggctcgtcgccaccttctcctgctggccctgacccatcccacaccctcccattttccgctacacggaatcaacaatccgtataacgaagctatctgggcggcttcccgctggtcaacaccctcttgaacctcgggccgcatctcctggaccatcctgactcgtgaccgaaggaggacgcgtgtcgaacaccagccgagtgacccgccgcacggggctcagaaccgcggcggccgtcgcggcggccttacccctgctcagtgcctcgcccgcctccgcctcgcggaaccgaggccgccgcctggacgtgatgacgttcaacctgcgcttcgcgagcgcctcggaaccccacagctgggccgttcgccgccccgtcatgcgcgagctgctgcgccgggagcggccccacgtcatcggcacccaggaggggctctaccagcaggtgcgtgacatcgaggccgacctgggcccgcactacgactggatcggcacgggccgcgcgggcggcagccgcgacgagttcatggcggtcttctacgacacccgcaggctcgccccgctggagtacgaccacttctggctctccgacacccctgacgtgatcggttcgaacacctggggcggcggctccatccgcatggtcacccgggtccgcttccgcgatctggcggacggcgaccggccgttccatttcctcaacacccacctggacaacgcgagtcagtacgcacgcgcgcgtgccgccgccctgatcgccgaccggatcgcgggcctcgaccgctcccagccgctcgtggtgaccggcgacttcaacgccgccgcgcacaagaacgcggtctacgagacgatgctgggcgccggactcgtggacacctgggacacggccgccgaacgcggcaagctgtacgggacgttccacggctacaagccgctggtgccggacggcgaccgcatcgactggatcctggcctcgcccggagtggccgcgcactgcgcgtcgatcaacgcgttctcgtcgaacggtcagttccccagcgaccatctgcccgtgcaggcgtccctgcgcctggcctgaggcgagggcccctgcgatctgcgcctggcatgaggcgagggcccctgcgatctgctcccggcatgggacgaggcccctgcgaccgtgacggtcgcaggggcctcggagcagccgatgcggtcagcccttgcgggtcttgacctcgtcggtgagctgcgggacgacatcgaagaggtcgccgaccacgccgtagtcgaccaggtcgaagatcggggcctcggcgtccttgttgatcgccacgatcgtcttcgaggtctgcataccggcgcggtgctggatcgcgcccgagatgccggaggcgatgtacagctgcggcgagacggccttaccggtctggccgacctggttggagtgcgggtaccagccggcgtccaccgcggcacgcgaggcaccgacagcggcgccgagggagtcggcgagcgcctcgatgatcgcgaagttctcggcgccgttgacaccgcggccgccggagaccacgatcgcggcctcggtcagctccgggcggccggtcgactcgcgcggggtacggccggtgaccttggtgccggtcgccttgtccgagaacgagaccgacagggcctcgacggcgccggcggccggggcggcctccacgggagccgagttcggcttgaccgtgatgaccggggtgcccttggagacacgggacttggtggtgaacgaggcggcgaacgccgactgcgtggccaccggaccctcgtcaccggcctccaggtcgacggcgtcggtgatgatgccggagccgatgcgcaccgcgaggcgggcggcgatctccttgccctcggcggacgacgggatcagcacggcggccggggacacggcctcgtaggcggcctggagcgcgtccaccttcggtacgaccaggtagtcggcgtactcggcggcatcgtgcgtgaggaccttgcccgcaccgtgctcggcgagcgcggcggcggtgttctccgcgccggagccgagggcgagggcgaccggctcgccgatgcggcgggccagcgtcaaaagctccagggtgggcttgcggacggcaccgtccacgtggtcgacgtagacgagaacttcagccatgggaatgctctcctgcggattgcgaagtctgaggggcggtaaggggtgtgggccttagatgaacttctggcccgcgaggaactcagcgagctgcttgccgccctcgccctcgtccttgacgatcgtgccggcggtgcgcgccggacgctcggtcgcggagtcgaccttggtccaggcaccctccaggccgacctcctccgcctcgaggtcgaggtcggacaggtcccaggactccaccggcttcttcttggccgccatgatgcccttgaaggacgggtaacgcgcctcacccgactggtcggtgaccgacacgacggcggggagggaggcctccagctgctcggaggcggagtcgccgtcccggcggcccttcacgacaccgtcctcgaccgacacctcggacagcagggtcacctgcgggacacccagacgctcggccagcagcgccggcaccacgcccgccgtgccgtcggtcgacgccatgccggagatcaccaggtcgtagccggccttctcgatcgccttcgccagcaccagcgacgtaccgatcacgtcggtgccgtgcaggtcgtcgtcctcgacgtggatcgccttgtcggcacccatcgaaagcgccttgcgcagcgcgtccttcgcgtcctcggggccgaccgtgagaacggtgatctcggcgtcgtcggcgtcgtcggcgtcgtcggcgatctgcagcgcctgctccaccgcgtattcgtcgagctccgagagcagaccgtccacgtcgtcccggtcgacggtcaggtcctccgcgaagtgccggtcgccagtggcgtcgggcacgtacttcacagtgacaacgatcctcaagctcacgccggctctcctactgcatcgtcatttctgagctacctcttgcaggcagcataggcgcctgaagcggccgatcccggtcggggcggcccgcgctccgaacgaaatattactcgtcagtacacatagtgaatgcccgctaagcaagcgctttgaactgtgaccttgacaacgctgcgtaatcgggcggcggatcagtcacggaggccgctgaagcgcccctggtgatagaggagcggccgtccggcgcctgtcgggtcacccaggacgacctccgcgaggacgatgcggtggtcgcccgcgggaacgcgtgccacgaccctgcacaccagccaggcgagcacgtcgtcgagcacgggtacgccttccgggccctcgcgccagcccgtggacgcgccgaagcggtcggcgccgctcttggcgaagacaccggccagttcctgctggtgctcgccgagtatgtggacgccgacgtgggcggtctcggagatcgcgggccagctggacgcgccgacgccgatgccgaacgagacgagtgggggctcggcggagaccgaggtgagcgaggtggcggtgaagccgacggggcccccatcgccccgggccgtgatgacggcgactccggccgcgtggcggcggaagacggagcgcagcaggtcgggggaggcgagctgggtgccgaggtcgggcgtggccgtcatggagttgtccttctgcgagaggtggggagcggttccggggctgttcaacagcccggacaccgcacactcgcggtgcgggccagggccgcagtccgaatgcgtacgcgctcgaagagaaggagttccgggggcatacggtcaggctgacgataggtggcgcgtgcagtcaagtgcgttccgggatctgggagcctcgtcaccacggatcagaccgcctctcccagcgcggcgatgacatccgccttgcggggctgccccgttgcgcgccgcacgatccgcccctccgcgtcgaggacgagcaccgtcggcgtcttgatgatgtcgagttcgcggacgagttcgagccggtcctcggcgtcgatctccacatgggtgaccccgggaaccagcccggccacctccgtgaggacccgccgggtggcccggcacggcgcgcagaaggcgctggagaactggacgagtgtggcccgttcgccgagcccctcccccaactccgccgcgccgaggtgctttccgccgtcgcgcccgcgcactctcactctcccgctccgccgccgatgcagcactccgtacgcgctcgccaccacgagcaccaccacgcacaccacaagtccggtcatccccgccttcagcgttcccgcggccgtggagattcccgtgttcacgagactgcaaagattccctgctcctcaccagcgctcccggtgcggaatgcttgattcatggacattgatgtgagggggccgcgcttcggggcggccgtgacgaccgtcgtgctggcggtggtgctgatcaccggcagcgcctggctgctggcctggcagacgctggccttcgcgctgggcgcggcgggcggtgccgggcgctcgccgtacgggtggctgttccggaaggtcgtgcgcccccgcttggggccgccgacggagttcgaggcgcccgatccgccgcggttcgcgcagacggtcgggctcggcttcgccgccgtgggtctcgtcggctacacggtggggccgccgtggctgggcctcgccgcgacgggatgcgcgctcgcggccgccttcctcaatgccgcgttcgggtactgcctcggctgcgagctttacctgctggtgcgcagggtgacggtgcgagcggagtaaagcactgggaaaactccgaggtcgaccactcggctgacgtgacgaggatctcgccgttcccgggcaccaggactggccactcgtccgttcttggggcacgatctgcgcaatgccgtaaacctacggctgcgtaactttcccgccgggcgccccattccaggcagagagaagggtccaccccgtccatggcagagcttgtctaccgtcccgtcgtcggtctcgcccaaacgttgttcaaggcctgggacctcaagatcgactgcaagggatcggagaacattccgcgctcgggcggcgccgtgctggtcagcaaccacatcagctatctggacttcatcttcgacggcctggccgccctgccgcagaagcgtctggtgcgtttcatggcgaaggagtcggtcttccggcacaagatctccggtccgctgatgcggggcatgaagcacatcccggtggaccgcaagcagggtgagacggcgtaccagcacgcgctggactcgctgcgctccggcgagatcgtcggtgtcttccccgaggcgaccatctcgcagtcgttcaccctcaagagcttcaagtcgggtgccgcgcgcatggcccaggaggccggcgtcccgctgatcccgatggccctgtggggcacccagcgcctgtggaccaagggccacccgaagaacttcaagcgcagccacacccccatcacgatccgggtcggggagccggtcgaggctccgaccgaccagtacgcgggcgcgatcacgcggcggctgcgcgagcgggtccaggagctgctggaggccgctcagcgcgcctatcccgtacgccccaagggtccggacgacacctggtggatgccggcccatctcggcggcacggcaccgacccccgaagaggtgaaggcggccgaggcccgctgaatcgtcacaccggggcgcggacggtgatccgcgcccccgggctgaacttctcgagcagttccgcgagctcggcagccgccgcctcgaggtgggccaccggcatgggggcgagactctccagcaggaagaccgccgaggccgactcctccgtgagccgggtccgcggtccctggcgccagttccagcggcggcaggtgacaccggcgtcgtcgcaccacacgacctcaccggcgtcggggtgttcgacggcctcctcacccgcggccaccgtcacgaactcctcgtcgcccgtggcccgcacaagacgcattccgccctggacgcggtcgaggtcctcaccgccgaccgggatcagatgggcgacgctgaccgcgttgtagaggtcgacgagcatgttgatacggggcagtccggcatcggcgagggcccgcttcgccagcgcctcggcggagttgcgggtgcgcgacggcttggagccgaacgccgtgtacacctcacgccaggccgccatgtgcgggtcctcgtgcggggcgcgaccgtcgaggcgtacggcgagccgacgcgccgcgtcctcgaggagtgccgcagtaccttcgttactgggcccgttgagcagtccgtgcgcctcgacggcgacatgggtgaagccgggtgcgagggcgcgcacctcgtcggacacggtgagcgtgagcgtcatcttcctgccttgcctcagagtgcggtggggagcgtcttccacaggtgcggccggtcgtgcgcggcttggagagcgcccagaaccgccggatgaggttcagcatacagaactggatagtccaactcattggactcgggatcgggagtgaaggccagccgctccccgtcgagcgagaaccgggcgtcgacccccggcttgtttccgcggggatcctgccggtgccacgcgccgtcgaaccgcacggcgaccagcccgtgcaccaggtcgagcttctggtagcagagcgccgtggggatgtcctcggcccgcagcagcgcggccagcgcgtgggccttggcgtgacagattccggtgccctcggccaggacgtcggaggcgcgccaggtgacgcgcaggtctccggagtccgccgagtgcgggatggcgtcccgtacgaattcgtacgccgatcgcgcataggcatacgagtccacggcctgctcggccaagcgcgcagccgtctcccgcacccgcggatggtgatgatcgatgacctcgccagcggccaagtaggcggacaggtccggggtctcctgcgtcagctccatacccgcagagcatagaaatgcgaccacccgagcgtcaatgacttttcgagtgatcgcatatctatgcatcgaggcgggtggctgtgactaccgggccatctcctccttgagcgccgccacgaatccgtcgacgtcgtcctcggtcgtgtcgaaggcgcacatccagcggacgtcgcccgcggcctcgttccagaagtagaagcggtagtgcttctgcaggcgctcactcacgtcgtgcgggagacgcgcgaagaccgcgttggcctgcaccgggtagaggatctccacgccgtggaccgcgcgcacgccctccgcgagccgctgggccatctcgttggcgtgccgggcgttgcgcagccacagatccttggcgagcagcgcctccagctgcaccgagacgaaacgcatcttcgaggccagctgcatggacagcttgcgcaggtgcttcatgtggctgacggcgtcctggttgatgaccacgacggcctcgccgaacagcgcgccgttcttcgtcccgcccagggagaggatgtcgacgccgaccgcgttggtgaacgtccgcatggggacgttcagcgaggcggccgcgttggctatccgggcgccgtcgaggtgcaccttcatgccgtgcccgtgggcgtggtcgcagatcgcgcggatctcgtcgggcgtgtagacggtgcccagttcggtgttctgggcgatcgagacgacctgcggcatcgcacggtgctcgtcgtcccagccgtacgcctgccggtcgatcagctcgggcgtgagcttgccgtcgggcgtgggcacggtgaggagtttgaggccgcccatgcgctcgggggcgccgccctcgtccacgttgatgtgcgcgctctccgcgcagatcaccgcgccccagcggtcggtgaccgcctggagggcgacgacgtttgcgccggtgccgttgaagacggggaacgcctcggcgccggcgccgaagtggctgcggacgatgcgctggaggttgtccgtgtactcgtcctcgccgtacgcgatctggtgcccgccgttggccagggccagggcggcgagcacctcggggtgggcccccgcgtagttgtcgctggcgaagccacgtacctccgggtcgtgatgccgccgggcgtcggtcttaggagggttcacggcttctcggtcagccacagacggtttccgttcacttcggcggcggactgctcccagacaccggcgatggcctcggccagctccttgacgtcggtgaagcccgcgaacttcgcattggggcgctcggcgcgcatcgcgtcgtgcaccagtgccttgaccaccaggacggcagccgcggacgtcggcccgctctcgccgcccgccttgcggaagtagtcggcaagggccagcgtccacgcctcggcggcggccttggcggaggcgtaggcggcattgcccgcggtgggcctgctcgcgctcgaggcgctgatcaggaggtaccggccacggtcgctgcgctgcaaggcctcgtggaacgcgagggaggtgtgctgcacggtgcggatgagcagcagctcgaggaagtcccagtcgtccaggatcgtcttggtgaaggtctcgctgccgcgccagccgccgacgagatggaccaggccgtcgacgcggccgaagtccttctcgatgcgcgtggcccagtcccgggtcgactccaggtcgaacaggtcgaccgtgtccccgacgacggtggcgccgccgtgcccgtagcgggccgcgtcgacggcttccgcgagccgctcggggtcgttgtcggagccgacgacggtcgcgcccgcgtcggcgagccggacgagtgtcgcgcgtccggcgggtccgcccgcgccggccaccgcgatcaccgcaccgctgagagcaccgttcctcatcttcttcgcctcctgagcagtgttctcggcgccgtcgctcacgcggcggcccgctcggcactcgtcgccgtgatgcccttggtggaggcaatcacgttcttcagcttcttggcgagcgcctcatagaacatgctcagcggaaactcgtccgggagcacgtcgtccacgagcttgcgcgggggctgggtcaggtcgagggcgtccgggcccttggcccagcgggagccggggtgcggggcgaggtaggtggagaccagctcgtacgccttgaaccagtggacgagcttggggcggtcgatgccggcccggtagaggtcctcgatctcggcgcacagctcgttggtgacctgcggggcacgctgccagtcgatgtgcagcttgttgtccgtccagcggacgacgtcgtgcttgtgcaggtaggcgaagagcagctgcccgccgaggccgtcgtagttgcgcacgcgctcaccggtgaccgggaagcggaacatccggtcgaagagcaccgcgtactgcacgtcacggccctgcgggaagccgtcggcctccagcttcacggcctccttgaaggcggtcaggtcacagcgcagctcttcgaggccgtacatccagaacggctggcgctgcttgatcatgaacgggtcgaagggcaggtcaccgtggctgtgggtgcggtcgtggaccatgtcccacagcacgaaggcctgctcacagcgctgctggtcgtggaccatggcggcgatgtccgcgggcagctccaggcccagggtgtcgacggccgcgtcggtcacggcgcgaaaacgggcggcctcgcggtcgcagaagatgccgccccagctgaagcgctcgggggcctcgcgcacggcgatggtctccgggaagaggaccgccgagttcgtgtcgtagcccgccgtgaagtcctcgaaggtaatgccgcagaacagcgggttgtcgtagcgggtcgcctccagctcggcgagccagtccggccagaccatgcgcagcacgaccgcttcgaagttgcggtccgggttgccgttctgcgtgtacatcgggaagacgaccaggtgctggaggccgtcccggcggtgccccgcgggctggaaggccagcagcgagtccaggaagtcgggcaccttgaacccgtcgtcggaccagcggcgcaggtccttcaccaaggccgcgtggtaggcggcgtcgtgcgggagcagcggggagagctcctcgaccgcgtctatggcacggcggacggccagttcggcgtcggaggcgtccggcgcgccctcggcctcgaagtcgatggagccgtccttcgactgccatggccgaatctgctccacggcatccttgagcacgggccaagccgggtgctccaccaccctgacctgcggaggaacctgctcctccgaacgctcctgcacaagaatttccgtcataacccatcctccacgagagaacctcacgtatggacaccgtatgcatatgaggtttcttccagcaagtaggggttcgggaaattatcctgcctcacccccgccttcaccgctctttttcctgccggacaccgtagaggcgacgacttccgctatcgaccgctgggcatcccgggcgtccgcgacgggttcggcgagaggttcggcaaggggttcggcgaggccgaggaatccatggagcatggccggataccgactacaggtgaccggcaccccggtcacacggagcttcgcggcgtaggccaggtcgccgacgcggcggctaggtgccggcgggcctcggccgtcggcgacactgccgccgaggtcgggagagtgctccttgacggcgtcggccggcggcatgaagtcacctcccgaagagccgaacatcccgggggcgcatgccatatgaccattcgtcagtttcatgccaggcgcatgcccgcgacctcggtcaacctccgcgtgacgcgcccacccaggggtgacgcggaccggctgtacggcccgggccgccgttgggcggggccccattcacccgtgtacaagcgggttcatcgcggaccgggagcattaggctgcggccttgccgcgtggccacgggagcgcagtacgcggcagccgagccgccgtcgacggaagcgagttgagccttgaacttcctcaccatcggtcaccgcggagtcatgggcaccgagcccgagaacaccctccgttccttcgtcgccgcccagcgtgcgggcctcgacctgatcgaactcgatctgcatctgagcaaggacggggccctcgtcgtcatgcacgacgccgaggtggaccggacgaccgacggcacgggaccgatcgccgagaagaccctcgccgagctgcggacgctggacgcgggccggggcgagcgcgtccccgtcttcgaggaggtcctcgacgccgtcagcgcaccgctccaggccgagatcaaggacgtggcggcggcgcgggcgctggccgaggtgatgaaccgcagggacctggtcgcccgggtggaggtgctctcgttccacgacgcggccatcgccgagatctcccgcctcgtgccgggggtacgcaccgccctggtcgccagccgctacggcaccgacgtcgtcgaccgtgccacggcggtcggcgccaccacgctcgtgctcaacatccggcggctgacgctggagatcgtcgagcacgcgcgcaaggcggacctgaggatcatcggctgggtggtgaacacccaggaccatctgcggctcgtccgggcgctgcaactggacggcgcgaccaccgactacccggagatcaaacgcaccggccgtttcaccgcatgaacgtcacgccagcggcttgaccagcagctcgaactccaggtcgtcgcgctgcggaacgccgaagcgctcgtcgccgtacgggaagggggtcgtctctcccgtacggcggtagccgcgccgctcgtaccaggcgatgaggtcgtcgcgtacggagatcacggtcatgtgcatcgcggcgacgccccaggcctcgcgggccgcccgctccgcctccccgatgatcaccttgccgaggccaccgccctggagggcggggctcaccgcgaacatgccgaagtaggcgtggtcaccgcggtgttcgagctggcagcaggcgacgaccgcgccggcccgctcgacggtgagcagtcggctgtccgacgacttgatcaccgcgcgcacgccctcggggtcggtccgctgcccttccaggatgtccgcctcggtggtccagccggcccggctggcgtccccgcgataggccgactcgatcagcgcgaccagcgcgtcgacgtcggcgtcggtggcgtcgcggaaggtcagtccggtggcggcggtgtccatggggcacttctccgatctctggcggggctcgggcaccgctgagcgtaaccctcgcactaggctccgtttgtatggtccacgtactgagcagccgcacccttctgcgccccaccgacccggaacgctcccgcgccttctacggcgagaagctgggcctcgccgtctaccgcgagttcggcacgggccccgagcgcggcacggtctacttcctcggcggcggctttctggaggtcgcgggccgctcggacagcccgccgtcaccggccctgaaactgtggctccaggtgcctgacgcgggcacggtgcacgaggagctgaagaacgccggcgtcgagatcgtccggccaccggtacgggagccgtggggcctgatcgagatgtggatcgcggacccggacggtacggagatcgtgctcgtggagatcccggcggaccatccgctgcggtaccggcccgggatctgatgccgctcgcggggcacgggcttagcctgctggagggggccggaccggcggaaggtactccatgaagctcgacaggccggtgaccggcgggccctgctggaccgagctgggcaccagtgatctggaggcggccaagcggttctacaccgacctgttcggctggcggctggagaccgaccctcggcaggaggccggcggctataccgtcgcgcacctcggcgacgcggccgtcgcggcgatctccccgcggtacgaggagtcgcagccggtcgcctggaacgtgtcgttctcggtggcggacgcggacgcggccgtcgccacggtgcgggacgcgggcggcacggtggtgctgggcccgatggacgtgttcgacgtcggccgtttcgcggtggcgtccgatccgggcggcgcggccttccagctgtggcagccacgggccttccccggcgcggggctgttcaacgcgcccggctcgctcggctgggtggagctgctgacgcgggctgccgagcaggccacggcgttctacacgaccgtgttcggctggagtgtcaacgcctccgagcactacacacagtggggtgtcggcggcgccgacttcggcggcatggtgacgatggacgagcagttcccgcctcaggtgccgtcgcactggctgccgtacttcgcggtcgaggacgtggacgccaccgcgcacgacgcgaccgaggcgggcggcagcgtactcatggagcccacgtccgtgccggacggaccacggatcgccgtcctgcgggacgcgcagggcgcggccttcgggatccatgtgggcggcgaggagggctaaccaccgggcttcatcggcgtgagctggtggatgccatggcgtgtgcgtgcctcggcgatcgctctctggtcgggcgggcccggggcgtcgaggatgtcggcgatctcccggatgtagagctcatggccggccggcgccgcgaggaagagcatccgggcgggcaccgagccggggttggcgaacgcgtgcgggcatcccgaaggcacgtacatcatgctgcccgggccgccgcggacgaccttgtgaccggtgccggactcccaggcccgccagtcgccggacgccctgatccgcggctcgaaggccagcagatcgagttcgccgtcgagtatgtagaacagttcctccgcttcgtcgtgcaggtgtgcccccacgtcgaaccccggctccacatcggcctcgaacaccgaccatcgggccgagacgtcggcccccaccttgagcgtcatgccggacgtacccatccggcggcccgacccgggcgacaggaccagtccatgggtcatggcgcacatcgtcccccggaagccgggcctcaggaaggcgtcgggcctgcggtgtcaacgacacctggccgatgaccggggcgcacgcggcgcgttgtcgaagtggacagagggcaccgggcgggctcagccgcgcggcacgccgagcctgccctccagctggaccagcaattcgccgagcaggcccgcgagttcaccctgcccttcgccgtcgaggccggacagtacggcgctctcgtaggaaagctgctcgggaaggatgccgtcgaccagctcgcgcccggcgtccgtgagccggacgtgggccacgcggcggtcgcgggcgtctccgcgccgttcgaccaggccgcgctcggtcagctgcttgaggcgcttggtgacggcggccccggaggagaaggtctcgcgggcgatctcgccgggcgtcagctcatggccggtgcggcgcagcgtgccgaggacgtcgaactcgggacgggtcagcccgacgcggcgcagcggggcgtcctcggcctgctggaggagggccgcgcagcggttgatgcgcccgatgatctccatgggtccggtgtcgatgtcgggacggacggcccgccactggcgcaccacggcggccacggtgtcgtgcgccgccgcaccgcccccgtcggcgccgctgccggtgtgcggccgcccgcccgccgtgccgcccccggtgtccgtccgtccgtccgctgccgtcatgccggtgcaccctccgtggtgtgcagtccctgccgtcgtaccgtcgccgcgagcgtacggtgtccggcctgctcggcgagcaccacccgctcctccggcagggcgcgctgccaccactcgccggccgcggcgtccgtggtggcccgcagatccacgaccgcggcggccagctcgcggcgggcggactccagggccccgggctcagggtgctcggcggtgacggtcttcgccgcgtgctcccgggcgctttccagggcgtcgagggcgagctcgatgcggtcgccggcccgccggttggtcaccgcgaccgccgcgacgaagcccaccagggccccgacgagggtgtccacgacccggtcggtcatcagctcgccgggttcctggaggtgcgcgaactcggtgatgagcagggccatcggggtcacgcacacgctgccgagccagtagttgcggccgatgagtgcctcggcgccgaagttgagggcgaggcagctcagcacgagggccgccgggccgagatgcgcgagcggggcgatcgcggcgaaggcgaggacgcccacgaggttgccgactacgcgctggatgccacggctccaggtgagcgtgacgttggcctggtagagcgaggcggccgtgaccagcgcccagtaggggcggccgacgccgagggcgagcgcgacgtatccggcgagggcgcacccgagggcggtgcgcagcgcgatgggcgcgagggggccgagccggctgagcaacggccgtgcggggctgtcgagttcggcttccacaccgagcagttcgtccgtcgtgccgtcgccagcccgcgggacgcgcgggatcgggatcggccccttgccgcgcagctcgcgggcccaggcgcgcagctgcccggcttcggcgtccgcgggcacggcgagcgcgacctcggcgcgcacgacgagccgttcgagggcacggcggggcgcggtacgggcgccggtggacagcagcgactgccaggccgcgtgcacggcggcggccgcaccggcgcgggcccgggcatgtccgtcgccggtgccccgtgtctcggcgtacgcggccgcggcgttcagggcatgggcggtggcgcgccgctcgggcccgtgcggccgtacgagaccgggggccatgcccacgatccaggcccaggcacccgcggcgaccgcgagcgccagatgtccggggacctggccgagggtccccggcgcgaacaaggaagcggagctgatgaaggtgagcacgacatgcccgggcgggccgatgcgggtcgcgtcgcacaccgccttctgcgcggcggccagcagcgcccccacggtgaccagcacgacggcgctggtggtgagcgacgccgcgatcagggcgaccgcgagcccgccgatcatcccgagcaccacccaggcgagggcacgggcccgggcggcgtacgggcggttgtgcgcgtagagggcacagagcgacccggccatcgtgtacatcgccagatcgaggcggccgagcgcaaggagggtcaggttgggcggtgtgaccgcggcgaccacgctcagggcgggtttgaaccagatgtcggagggccggccgaggcgcagcacgcccacgagggggagcggacggacgcgggaggtggtgggggtcgcactgctcatgcgtttaacattagcaggtgttttactcgtaaaacattgcctgcgggccggtgcgcgtcccgtgcgctcccccgcgtacccctgtgcgctcgcgtgcgcaccgtccgtgacgggcatgccctgaccgactgtccgacaccgtcgagcggggaggtgcgcggtgcacggatcggcttcgcccggctggctgctcgtcgcgctgtgcgcggcgaccgggacctactgtctgctgcggatgcgcagcggcgtcgaggagcagcgccgggccgcgggcggcgaggcgctgatggggttcggcatggcggccatggccgtaccggccgcggtggccgccccaccccggtgggcctggctggcgtacgcggtggtcttcggcgcggccggcgtacgggccctgtggggggcgcagaccggcgcacaccatctgcaccatctggtgggcgcgttcgcgatggcctacatggcgggggtgatggcagcgtcccccgcgcaccacgagcacggtgccgcctccgggctgccgccggtgacaggggtgctgctgctctacttcgcggggtacgtgctgtggtccggggtgcggctgataccggtggcgtccgtggcggggggcggccggagcgtcggctggggcgaccggcccgaactggcgcgggcctgcagactctccatggggatcgccatggtcgccatgctcctcacactctgaccacgcccgatccgtccgcgccgagtcgcagtggcgcgaagccgaatcccagtggtgtacgaagccgagtcgcagaggcacgaagccgagtccgggccgcacgaacccgtggcgtgcgtcactttgccatgacaggccgtatcctccggcgccgccccgctcataggctgcgccccatgatggtccccgcggcactgttgctgctcggcgccctgaccgccgtcgtcgcgccgcggctgctcgccctggccgactggccggaccgtgaaccggtggtcgccctgtgggtgtggcagtgcgtggtggcggccgtactggtgtgctgcgcgctgtcgatgaccctgagcgcggccgccgcgtgggtggccgtgcgcggtcatgtgttcgccggggcgccgcacccggtcgtggaggcgtacgcgctgagcaccgggggttcctgggcgtcgacgaccgccgtgatgctcgcgggcggcggcgtgtggagcgcggcgatgctggtccgtgagatcgcccgggcccgggcccgccgccggcagcgccgggccgaacttctcgtacgcgcaccgctgttgcccggcgaggaacccggtgccgatcggctcgtggtgctggagggcgagcggcccgatgcctggtggctgcccggggccgcgccccagctcgtcatcaccacggccgcgttgcgccggctcaaggggcggcagctggacgccgtcctcgcccatgagcaggggcacgcacaggcccggcacgactggctgctgcactgttcgggcgcgctggcgggcggctttccccaggtgccggtcttcgccgcgttccgcgacgagatgcaccgactggtcgaactcgccgccgacgacgtggcgtcccgccggttcggccgcctcacgatcgccctggcgctggtggaactcaacgaggaccggggcgtgttcggcccctgcccgaccccgcaggcccacgttccgcagcgtgtccaccgcctgctcactcccccggaccgcctcacggccgcgcgccggctgcaactgacggcggccgcggcgctggtgccggtgattccggtactggtggcgttcgtaccgggactgcgggcgctcgggtaatcaccttttccagccaccggtccgcccgtgccgaacgacggcgatcctccggtcccgcgatcctcgttcgcctccggtcccccgggtcggagaggatcactccatgcactccccgcccgtcggctcgccgccccgaccgccccgtccccgggccgccgcgcgcgccgtggtggtgctcgccgccgcgtccgcgctggtcgtcctgctggtcgccctcccctggcaaccgctcatcgccctcgacggcgacatctcgcgcgccacacaccgctgggccgtggacgaacccggtgtcacccacgccttccgcatcctgacggactgggtgtgggacccgctgacgatgcggctcgcgtgtgcggcggccgtcgtgtggctggtgtggcggcactccgcgtggcggctcgcgctgtgggtggcggccgcgtgcgcgctgggcacgctgctgcaacaggtcctcaaggccgcggtcgaccgtgcccgtcccgtgtggcctgatcccgtggactcggcccactacacggccttcccctcgggccacgccatgacggccacggtggtgtgcgggctgctcctgtggctgctgcgcctgtacggcgccgggcgcgcactgtggcgtacgggcgtcgcgctggcggcggtctccgtcgtgggagtcggtctgacccgcgtatggctgggtgtgcactggccgtcggacgtgctcggcggctggctgctcggggcgctggtggtggcgggcgcgatggcgtcgtacgggcggtggcacggctcagggcccgcttgacccgcttgacccgcccgcttggatggtgtgacccgcttgacccgattggatcgtgtgacgaaggatcacctgtatggcgatcaaaggtgtgctcttcgacttctccggaacgctcttccgtatcgagtccaccgagtcctggctgcgcgcggcgctcaccgcggccgaagtccccctgccggaaccggagttgatccggaccgccgaggaactggagtcggtgggcgcgctgcccggcggggcgctcccgtcccagccgctgcccgcccgcctcgccgagctgtgggaggtccgtgaccgcagcgccgcccagcaccgggccgcgtacaccggcatcgcccgtcaggtgccgctcccggatccacgcctccacgacgcgctgtacgaccgccacatggccccggcggcgtggtccccctaccccgacgcggccgaggtgctcggcgcactgcgcgagcgcggggtcgccgtgggggtggtcagcaacatcggctgggatctgcggccggtcttccgtgcgcatggcctcgccccgcacgtgggcgcgtacgtcctgtcgtacaagcacggcatccagaaaccggacacccgcctgttcgccctcgcctgcgaggcgctcggcgtcgccccgcaggacacgctgatggtcggcgacgaccgccgcgcggacggcggcgcggcggccctgggctgcggagtgcacttcgtggaccatctcccggccccggaacgcccggacggcctccggccggtactggaactggtcggctagggcacctgcggccagtgctccgtccgtgcacgaccgccctggacgctcccccgcgacgcccagggcagacggcaaccgccggaaccgacccgcacgaggccgggtccggatgcgctgagtatagttggctggcagccagtcaacgcaggagttacaggatgtccccgcgcagcgcctcggtcaatgaagagttgcgccggcgttcccgggaacggcttctgcaggcggccgtggagctggtgagcgagcgtggctacgaggcgacgacgctcggcgacatcgctgaccgggcgggctcggcacgggggctggtgtcgtactacttccccggcaaacgacagctcgtccagtccgccgtgcaccggttgatgcaccgcacgcttcaggaggcgctggaccgtgagccgcgtaccgaggacggcagggagcggatggcgcgggccatcgacgcgatcctgggcctcgcccgggaccagcccgtgctgatgcgccagcacatggcgggcatcctgcaagccgagggcttcatgcagtgtcctgagcagcggcggctggcggaactgctgcgcgagacggtcgcccgtcgcggctcgccggacgccgccaccgactatccgatgctgcgcgccctgctgatgggcgcggtctacgcggccctggtgccgggggctccgatgcccctgcccgtgctgcgggccgagttgttcaagcggtacggcctcgactgggagacaggcgccccgccggccccggagggggccgacgggacgtgcggcacggatctgtcgcgctttttcgcgacggagagccgagccggtgaggacgagggccggccgaagccgccggactccgtccccgggacgcgtcagtcgaagtagtccggctgcgtctggacgttgagctcacgcagacggacccgcttcgcggggtcggtccgccggtcggtgatcttcaggacgtcgaagcccttggcgatgtcgttcgagtagatgtaaccgttgtagtagtacgcggaccacgagccgccgaccgagagcgtcccggtggacagcggaccgcgctcgaagtaggcgatctcctcggggtgggccgagtcggtgaagtcccagaccgagaccccgccctggtaccacgcctggaccatgaggtccttgcccttgaccgggatcagcgagccgttgtgggccacgcagttctcggtgtccgcctggtggcgggggatcttgtagtagctcttgaagacgagcttgcgcttctcgcccttgccgacgatgtcgtagatgccgtcggctccgcggttcggcccgaccgtcgcgttgcaggtggccgcgccaccgccgcccaactcatcggtgaacacgaccttgttggccttctggttgaaggtggccgagtgccagaacgcgaagttgacgttgtcctcgacctggtcgaggaccttcgggtgctccggatccttgatggagaacaggatgccgtcgcccatgcaggcgcccgccgcgaggtccttcgagggcaggacggtgatgtcgtggcagccggtggttttggcgacgccggggttggtgggcgagccggggttgcccccgccgtcctggccctcacccgggaacagcaccgggaagctgacgacggccgccttctccggcgccttgcgcggcaccttgatgaccgagatgccgtcgtgcggcggctggcagtcggggaaggcggcgttcggcgagtacgaggacacgtagacgtagacgttcctgcgttccggcaccagcgcgtgcgtgtgcgaaccgcaggcggtctcgactgcggcgacgtacttcgggttcgccttgtcgctgatgtcgaagaccttcatgccctcccaggaggacttctcggtcgcgggctgtgtggtgctgttgcaggagctgtcgctgcgcgaggagtcggtggacaggaagaggaggtcgcccgagacggagatgtcgttctgcgagccggggcacagcacctgggcgaccgtcctgggggccctcgggttgctgatgtcgaagatgcggaagccgtcgtagttgccggcgaacgcgtacttgccctggaaggccaggtccgagttgaagccggtgaaagcctccttggggatgttggcgacgtgttcgatgttgtcggagtggacgacctcgtcctggccgggtatctcgccgtcggacatcgccgccctgacctgagcctgtgcgctccgggagacctccttctgcgtcacggcgccgtccccggggtcgggggtggcggccgccgggcctgccgtgagcaacgcggccaggagtcccgccgcggcggcggcaactcccgtggatctgcgccgccttcggggttcgttcaacagggtcactgcgtcctccctggttgccgttcacactggaacggttcacggacctccgaagtatcgtctctcccatgcggagatcaacaggtggcaacgtactcgtcacaaacgttcctgatccctctcgcgccctcaacagccgtgtccgccaaatgacttgggccacggtgtcactggccgtcgtggcgctcgcgctctcgggatgcgactccggatcggattcccccacggacgtcaagtccggtgcggcgagcggcccttcggtgatcgtgcccggcaagcccggagacgcgaacgagacgctctccgccgaggacgccgcgaagcggcggaccgacgacgactcccccaacacggcggacttctcctacgcacgcatgatgatcgagcaccacacccaggccctggagatgaccgaactcgccccgaagcgggccgagtcgggcaaggtgaaacgactggccgagcggatcgcggccgcgcaggggcccgaaatcgcctccatggaagcctggttgaagtcgcacggcggcgagcggaagagcacctcgcacgcacacgacacgatgcccggcatggcgagcgccgcacagctgaagacgttgcgggcggcgaagggccgggcattcgacgagctgttcctgacgctcatgatcacgcatcacgacggggcgatcaccatggccaccgaggtgaagtcgcagggcaacaacatccagatcgaggagatggccgacgatgtgatcgcgcagcagaccagcgagctcggccggatgcgcgacctgccatgacagccacgctcagcgccggacgtgacgtggtgtcaggaatcccgcgtcacgcgccccggcgatcagcctgagcgccctgcggcggctgtgcccggtcgcgcacatcaccgcgagcaccgggtcgatcccctcgccctgggcggcgagatactcctcggcgacgaggcgccgcccctcgatgccgcgcggccaggccggccgggcatggcgcgacgacgcctcctccggctcgcccgacggcccgggctccccgccgcaggcctcgaacagcgggccctcgatccagtcagccagtgccgtcaggtcgtcgagcgacagcggcggctgggcgcgtacgtcctcgacgaagacacccccctcggccagcaccgcgaggacgtcgacccgggccccgtcggcgaaggccaggcagacgtcgaaccaggacgtggtgacctcgtgctcccgcacctcccacgcgcgccgaacggacaccgcgccgtccggtcgatcgcgatcagaaagattgagaaaggattcttccagcacatacgcaacgtaagcaaatgatcacattcaatgcgaatcggcacgcagagcagatacacgacaggcccacaccttccccctcccttcggggcgtccgcggtgcgatcctggagccatcagcgacctccgccgaagcagggagtcccgccgtgctgcatgtcgccgtcgtaggttcggggccgagcggggtctacaccgcccagggcctcgtccagcaggactccggggtgcgcgtcgacgtcctggaccgactgccgtgcccgtacggcctggtgcgctacggggtggcgcccgaccacgaaaagatcaagtccctgcagaacaatctgcggacggtcctcgaacatgagcgggtgcgtttcctcggcggcgtccggatcggcccggacggggtgccggccacccggctgcgggagctgtaccacgcggtcgtctactgcgtgggcgccgccaccgaccgccatctgggcatcccgggcgaggaactgcccgggagctggtcggcgaccgagttcgtgtcctggtacagcgcccacccggactccgtcgccgacggcttcgtacgcggggcgcggtcggccgtggtgatcggcgtcgggaacgtggcggtggacgtcacccggattctggctcgcggaccgagcgagctgagccccaccgacatgccccaggcggcgctcacggcactggccgccagccgggtcaccgacatccacatggtcggacggcgcggtccgtcgcaggcccgcttcaccaccaaggagctgcgcgagctgggcgcgctgccggacaccgatgtcgtcgtggaccagcgggagctggcgctcgatccggcgtacgccgatccttccgggctgcccgccgcccagcgccgcaatgtggaggtgctgcgggcatgggccgaggcgccgccgaagggcgctccgcgtcgtatccggccgcggttcttcctgcggcccgtcgaactgctcgacggcggcgggcacgtgggtgcggtgcgtttcgagcggacggcgccggacgggcgcggcggggtggcgggcaccgggcagtacgaggacatcgaggcgcagctcgtgctgcggtccgtgggctatcgcggggtgccgctggaggggctgccgttcgacgcggagcagggcacggtgccgcatctcgcggggcgcgtgctgcgcgacggagcggtctccccgggcgagtacgtggcggggtggatcaagcgcggtccgaccggcgtgatcggcaccaaccggccctgcgccaaggagacggtgacctcgctgctcgcggacgcccccgttctcgtacggcgggaggtgccggacgatcccatggcggtgctgcgtgcggaggggctgcgaccggtcgagtgggcggggtggcaggccatcgagcgcgccgaggcggagctgggcgcatcactggggcggaacgtggtcaagcttcccgactgggcggcacttcgggcggcagctgcggggaccgcggcgcactagcaggtgtttgcaggggcgtcgaccgggacacactccggcaacaatccggaaatcaacaaactgttcaagacccttacggtctcgtgctgtccccatcgttcccgcccgccgctcctggagtgcccatggcaacgaccgcatccgtgcatcccgtcgacgaggtcccgcccatacgccagttggccgccttcgggctccagcatgttctcgcgatgtacgcgggcgcggtggccgttccgctgatcgtgggcagcgcgatgaagctgtcggccgcggacctggcttatctgatcaccgccgacctgctggtgtgcgggatcgcgacgctcatccagtgcgtgggtttctggcgcttcggggtacggctgccgatcatgcagggctgcaccttcgccgccgtgtcgccgatggtgctcatcggcacgacgggcggcggactgcccgcgatctacggttccgtgatcgtcgcgggcctcgcgatcgcgctcctcgctccggtcttcgggaagctgctgcggttcttcccgccgctcgtcaccggcacggtgatcctgatcatcggcgtctcgctgctgccggtcgcgggcaactgggccgcgggcggccagggggcgaagggcttcggtgagccgaagaacctggcgctcgccggattcgtgctgctggtggtgctgggcgtgcagcggttcgcgccggcgttcctgagccggatcgccgtactgatcggcatcgtggtggggctcgcggtcgcggtgccgttcggcttcaccgacttcggcggggtcggcgacgccgactggctcggcatcagcacgcccttccacttcggtacgcccaccttccacgcctccgcgatcgcgtcgatgctggtggtcgcgctggtgacgatgaccgagaccaccggtgacctcatcgcggtcggcgagatgacggaccgcggggtcgagccgcgtatgctcgccgacgggctgcgggccgacggcctgtccaccgtcctcggcggtgtcttcaacaccttcccgtacacggcgtacgcgcagaacgtgggcctggtgggcatgacccgggtgcgcagccgctgggtcgtcgccgccgcgggcggcatgctggtgctgctgggcctgctgcccaagctgggcgcggtggtcgcggcgataccggcgccggtcctgggcggcgcgggcctggtgatgttcggaacggtcgccgcgagcgggctgaagacgctggcgcgggtcgacttcaaggacaacgacaacctcacggtggtggccgtttcggtggcggtggggatgctgccggtgggggtgccgacgatctacgcgcagttcccggactggttccagaccgtcatgaacagcggcatcagtgccggctgcctgactgcgatcgtattgaatctgctcttcaaccaccttccggggaaggccggttcgcccgcgaaggccgccgagcccgacgaggcctcaggcaccgcctagccggtcggcctggtgggcgcacgcggtgaggacgctgtcgaggaggccggggaacagcgcgtccaggtcgtccttgcgcaggccgctcatcttggccgtgccccggtagatctgccggatcactccgctctcgcgcagcacccggaagtggtgcgtggtggtggacttggtgaccggcaggtcgaagtgcgaacaggagagctcgtcgccatcggcggcgagctctcgcacgatctggagccgcatcgggtcggacagcgcgtgcagcacggcttccaggcggatctcctcgcgggcggggtgcgcgagggcgcgactgcgtgcggtcggggcggcggtcgtcacggcggctccaatggtcggaaccccattgtacgagaaccctcgtagtttgacatctcccgtactacgatgcctaccgtacgagccggtacaccgtcccgcgatgaagggagtccgctgtgagcgcgctcttcgagccctacagcctgcgcgatctgaccatccccaaccgggtgtggatggccccgatgtgtcagtactccgcggcgccacagggccctgcggccggcgccccgcacgactggcacttcgcgcactacgcggcgcgcgccaccggcggcacgggcctgatcgtcgtcgaggcgaccgccgtctcgcccgagggccgcatcagcccgtacgacctcggcatctggaacgacacccaggtcgaggcgttccgccggatcacccgcttcctcgcggcccagggcacggtgcccgcgatccagctcgcacacggcggccggaaggcctccacggaccgcccctggaagggcggcgcgccgctcgccgccgacgagcacggctggcagccgctcggaccgagcccggtcgcgttcgacgagaggcacccggtgccgaccgaactgtcggtcgccgagatccggcagatcgtcggccagttcgcggacgcggcgcggcgcgccctggcggccggtttcgagatcgccgagatccacggcgcccacggctacctgatcaacgagttcctctccccgcactccaaccgccgcaccgacgagtacggcggctcgtacgagaaccgcgtccgcttcgccctcgaggtcgtcgacgccgtacgggaggtgtggccggccgggaagccgctgttcttccgcgtctcggccaccgactggctggacgagggcggctggaccgccgacgacacggtccgcttcgcggccgagctccaggcgcacggcgtggacctcctcgacgtctcgacgggcggcaacgcctcgggtgtacgcatcccgaccgggcccggctaccaggtccccttcgcggcccgggtgaaggccggaacctccctgccggtggccgccgtcggcctcatcacggacgccgagcaggccgagaagatcctcgccaacggggaggcggacgcgatcctgctgggccgtgaactcctgcgcaatccgtcgttcgcccggctcgcggcccgggaactgggcggcgacgtccatgtccccgcccagtaccaccgctccgtctgacgtcgcgcgcccgacgtccgacgcccgggcgtgacatcgcgcgtccgacgccgacgccgatgccgatgcccgggcggcccgggatccctgctcgacggcggcggccggccgggtggggggccggggcgggtcgccgacgaggagtcccgcgcggtgtgcggttacggctggggtcgtcggccaccgtgctcgtgggctacggcctgttcgtcaactccgctgccgtggccagcagttgctcccggccgatggcgtccgccctcgtcgccggtaccgtgcaggcgtaggctccggcgatcgaaccgtacagggcgcagcgcctgggtggctcgcccgccagccggccgaagaggtagcccgaggcgaaggcgtcgcccgccccgttggagtccaccaccggggccgggggtgtgacggtggggatgtgtgtcacctcgccgtcggccagcagatacgccccttcggcccccgccgtggcgacgacctcccgggcccggccgcgctcggcgatctgccgcatggtcttctccgggttcgccagggcggtggtcgacaggaacacgatgtcggcctcgtgggcgaacgcctcgtgatacgcctggacaccgtcccagttgtgcagatcggtggagatgctcacccccgtctcgcgcagcgtgggaagagcgtccgcgcaggggtgggtgatcgccacatgggcgtgccggctcgccgcggccagggcggccaccgtgggcgggggcagccgctcctcgtccggtgcgcggctgtcgtcgtacagcgacaggcggcgcccgtcggggcccacgagattcaccgcccgcttcgtacccgcggacagcggcacttcggtgagtccgattccccggtcgcggtggagcgcgcggaccaggtcgccctcccggtcgtccccgatcatgtcgatgtggtgcgtgcgcagccccagcgcatgcacgccgaccgccacgaagtcgccggtctgccccgcccgggtctcgatcgcgggcaccatgtagctgtccgcgtacgggagcggcagctcgggcacctgcacgatcgtgtcgaccccggcacctcccaggacaaggacgtcgatttcactgctcaaggcgctcccccagccggtgagttcaggaccacgagatccacgacgggcagcctacccgggcaaaaacgccggatccgctctcagcccgtcttacgcccccacatcggcccgaaccgtgcccagtcctcgtcccaccgctccatccgccgccgctccagacgtccccggaccagccgcccgcccacgaacggcccggccgccgcgctgacccccacgagaaggccgaccgtgacgccgcgcacctgcgcctcggaggggggcacgggcttggtcaccagaaggccgtcgcggtccgtccacacggtcaccggggtgcccgtggcgctgccggcggcgacgcgcgcctggccggagtgcgtcgaaccgttcgccgtggtccagcggaccttcgcccacacccggtcggcgccggacgaggccgcggcggacgactcgggcgcgtcctcggcgaccagggcgcggacggggcgccactcggcgcgttcccgggcgaggccctgctcgacggagtgtgccgccgcgagccccgtcagcacaccgcagagcacggtgacggtccaggccgagaacaggacccacgcctccagcacgtcgctgcggcgccgcagctggttgcgccgccatcgccacagggggttgcgccgccatcgcgccaggggcttgcgccgccatcgcgacctccatgcctggggaccacggaatgccgacatcgatggcaccctcctcacgaactcacggacacgccggaccgccctcccatacgcgagccgtccccctcgtgctcacgtgatgtccgtcaactcgtctgcccgcaagggcccgatgacagtcccgccggttcggcaagggctctttcgagggccgcgacgccgtcccgtccccctcccgccgcctgccggaaacaccgccctgacctcccggaacgacgcgtccggaggtgactgtcagtggtggggtgcagactggcccgtatctggaacaacgttgttgcggaggtggccgccatggccgaggtactgctcaccgtgggcacacgcaaggggctcttcgtcggacggcggcggggcggcgcctgggagttcgacgagagcccgtacttcaacgcgcaggccgtgtactcggtcgccatcgacacccgggacaaggcgccgcggctgctggtcggcggggacagcgcgcactggggcccgtccgtcttccactccgacgacctgggccggacctggaccgagccaccgcagccggccgtcaagttccccaaggacacgggcgcttcgctggagcgggtgtggcagctgcacccggcggccgccgagccggacgtggtgtacgcgggtacggaaccggccgcgctgtaccgctccgaggaccggggcgagagcttccggctcgtacgtcccctgtgggagcaccccacccgcgacagatgggtgccgggcggcggtggcgagggcctgcacaccgtcatcaccgacaagcgggacccgagcgccgtgacggtggccgtctccacggccggcgtgttccgcacgcacgacggcggcgcgagctgggcaccgtccaactccggggtctccgcggtgttcctgcccgatccgaacccggagttcggacagtgcgtgcacaagatcgcacaggacgcggcgactccggaccggctgtatctgcagaaccactggggggtgtacagaagtgacgacgcgggcggccactggacggacatcggcgagggcctgccgtccacgttcgggttcgcggccgccgcccatccgcaccgcggggacacggcgtacgtcttcccgatcaacgcggacgcggaccgtgtcccggcggaccgccgatgccgtgtcttccgcacggcggacgcgggcgaaagctgggagccgctcacggccgggctgccggacgaggaccactacggcacggtgctgcgcgacgcgctgtgcacggacgacgcggacccggcgggcgtgtacttcggcaatcgcaacggagaggtgtacgcatcggcggacgacggcgacagctggcggcaactggcctcgcatctgccggacgtgctgtgcgtacgcgcggcggtggtcgggtgaggcgggcgagtccccggtcaccttcggtcgcggaccgatcgcctcggagggccgtcgggaggggcggcgtccgtcacagtcgcaccgcctgacggcgtcgtctcctccacaaaaccgcacttcaggccgtcgaattccgtcaggttatggatcatgtgaataccaggcattggacgcatgcatccgtgttctcccaggctggtcggtgtccccgcccccgaccgttttggagtactcatgggcacgcagtggaacgccgtggacggtcgcatccggacgaccgcccgcggacacgccgtgctgaacagtccgcggctgaaccggggcaccgccttcacccggcaggagcggcaggaactgggcctggtgggtctggtgccgccgcaggtgctgacgcaggaccagcaggccgcccgcgcctacacgcagttccgttcccagcccaacgacctcgccaagaacgtgtatctgacggcgctgcgcgaccgcaacgaggtgctgttccaccggctgctcggcgaccacctcgccgagatgctgcccatcgtgtacaccccgaccgtcggcaccgcgatcgagcgctacagctatgagtaccgccgcccgcgcggcgtgtacctgtcggtcgacgcgcccgaggacatcgagcgcaccctgcgcgcgtccgggctgggcgccgacgacgtcgacctgatcgtggcgaccgacggcgaggcgatcctcggcatcggcgactggggggtgggtggcatcgacatcgcggtggggaaactcgccgtctacaccgccgccgcgggcgtggacccggcccgcactctggcggtgatgctggacgtgggcaccaaccgccaggagctgctggacgacccgctctatctggggaaccggcacccgcgcgtggaccgggagagctatgacgccttcatcgacgcgtacgtcaccgcggccaccgagctgttccccgacgccctgctgcactgggaggacttcggcccggccaacgcccgccgcatcctggaccggtaccgcgagaaggtccgcaccttcaacgacgacatccagggcaccggcgcggtcaacctggccgccgtgctctccggtgtgcgcgccggcggtgtcccgctgcgcgaccaccgcgtcgtgctcttcggcgccggtaccgccggcatcgggatcgccgaccagctccgcgacgccctgatcgccgacgggctgacgccgcaggaggccaccgaccgcatctgggccgtggaccgccacggcctgctcgccgaggaccagcaggggctgcacgacttccagctgcgctacgtccgtcgcggcgccgagatcgccggctggcggcgcgacgacgccctcggcggcgttccgctggccgaggtcgtcgaccgggtgcgcccgagcgtcctgatcggcgcgtccgggcagggcggggccttcaccgaggacatcgtccgcgccatggccgcgcacaccgaccgcccgatcatcctgcccatgtccaaccccacccggctggccgaggccgtccccgccgacctgctgacctggaccgacggccaagcgctgatcgccaccggcagccccttcgacccggtggaggtcgacggcgtcacccaccacatcgggcaggccaacaacgcgctggtcttccccggcctggggctgggcgccgtcgtcgcccgcgccgagcgcatcaccgacggcatgctcgtcgcctcggcacgcgccgtcgcggagcagaccgacgccacggcgccgggcgtgccggtgctgcccctgatcgaccggctgcgggacacctccgccgcggtggccgtggccgtggcccgcgccgccgtcgaggacggcgtcgcccgggagaccgtcgacgacgcggtcgaggagcgggtccgcgcggccatgtggcagccggagtacccgccgatcgaggccgtctgacggacgccggtccacggatcagcccactcccgtaagagtcgacgaccgtcggaactcgcctctccgacatgccgtcgccgggccgcgcggtcgcgcctccccctttcgaaggatggacccagccatgtctttcgccgagatcttcaccgtcgtggtgccggtcttcctcgtcatcgcggtcggctacggcaccggccgccgcgcgctcttcgacgccggcggagcacaggcgctgcgcgagttgaccatgcaactcgcccttccggccgccctgttgctgagcatctggcagacaccgcggcgggtgctggtcgagcagctgcccctggtgggccttctcgccttcgggctgctcggggtgtacgccgtcctgctcggcgtcctgcgcctcgccggccgtcgtccgctgcggcgggcggccctgttcgcactggcgtgcgtccagccgcagtacgccttcatgggtacgtccatcctcgggggcctgttcggtaccgcgcaggccgccgtgccgatcgccgtcgcgggcatcctcgtcaacgtcgtcctcgacccggtcgtcctgatactgctcggcatgccggaacacccggcgtcccggacagccgcgaccgcggcagccgccacctccgcggtacggcggccggccctggtgaccgtcggcggcggcgcgcctggggaatccgtggaagccgccgccccggtggccgccggggacgcgtcgcccgagcaccgtccctccgtgctgcgcaccgtcgggcacgcgctgcgcgagccgttctgctggggcccggtcctgggtctgatcctgtcggtcggcggggtcggtgtgccgaaggtcgccggcacctcgctgaccctgctcgccggggccgcgtcggccgccgcgctgctgtatgtcggcgtctccgtgtcccggatcggccgcccgaagctgacccccgcggtgtgggcgatcgccctcaccagcgtcgtcgtcctgccgctgctcgtctacggtgcgggtctggccatggcctccgcggccgacgccgcccaggccgcgctgatcgtcgcgttccccgtctcccccgtccctctgatgttcgccgcccgtcacggctcgaaggccgacgtgcggaccatcggctccgccgtcgtactgagcctgctcctctccttcgtcaccctcccgctgctcatcgaactgatcggctgactccggcctcagggccgtcgtttcgcccctgcccgggtccgaccactcccctcctggcaggccaagtgagcccacccgcaagcgaaaggacacggccgcatgacaccgacagccgacacgcgaccggaacgtccgccccgcacgtcccgtatgcggtggccgcgttccgccgccggctgcacgcccgtacgcctgcccctcgcggcggcggcgcggggtgccgtcgccctcgcgctgccgctgctcgtcgggctgcgcacggggtgggtggtgccgtccgtgatcgcggcgatcggcgccctgtggggcgtgagccaggacggctccgatccctaccgggtacgggtgcggcggctgggctggaccggcctgtccagcgcgctcggcctgctcgccggtgaactcgccctgcgcagcggggagccggcggccgtggcgggctgtctggtggctgccgcgctcgtggcgggcaccgtcggcctgcgggggcggatcgcgtccgtttcgggcatgcatctgctgctcggcgtgacgatcggcagtggcatccccgtgccgggaccgtggtggcagccgccgctggccctgctcgccggtgtcgccctcgtcctcgcgctgtccgcggccccgtggctgtggcgtcggcaccacgtcgagcgggccgccgtgctcgccgtgtaccggagcgcgggcgaggcactggccgcggccggcacccctcgcgccgaggaggcccggcgacggatgacgctggccctcaaccacgcccatgaggtgatggccgcccatctcgcgccgcgcgcccggcagcgacagcagtcggaagtccgggagctgatccgggcgttccactgcgccgtacggctgggcgaggccgtgacggcggtggtgtgggaggcccgtccgctcccgcccgccgtgaccggcgtaccgcagcagctgtccgagcgcctgctgccgggacggggctcggctcccgccgcggcagatacggcggcggagcaggcggtgccggcagtcgatgccggttcaccgggcaggcgggccctggccgaactgtgcgcgaccgtcgacggcgcaccggaccccgccgacctgacgctggatctgccggcgcgttcgtggcccgggcgggcggcacgtctgcgctatgccacgctgctcgcgggctgtgtgctcaccgcccatctgctcgccgaggccctgcacggtgcccgcggttactggctccccatgacggtggccttcgtctacaagcccgacttcggcccggtgttcacccgggcgctgcaccgctgcgccggcacggtcgtcggcgttgccgccatcggcgcggtgtccctggcggcgaccggcacctacaccgtgatcggcgtcgtggccgtcttcggcgccctgatggccgtcggcgtgcgccatcactacgcgctcgccacgctgggcctgaccgcggtcgtgttcgtgctcgtcgacctgctcggagaccaccgggcgctgtacggcacacgcatcctcgacaccgtcctggcctccgcgctggtgctcgtcgcgcacttcgcggtgtggcccgactccgcggcgaaccgggccgaggcgcagaccgaggccgccgtcgccgccgcccgccgctaccgcgaggtcgctccggaagcaggcctggtccagcggcagtcactgcgccgcgccgcgtaccaccagctggccgaggcacgccgggccgtcgcgcacgcccgcggtgaaccggctcgccccggccggccactgcccgactgggaggacacgatcacgacggccgaacggctctgcgacagggtgaccgcgcaggcggtggcgggcgcggcgggcccggcccgataggcggttccgtccggggtcgccgaaggcggaacccggccctgcctgcccgcgcgtgcctgcgtgcctgcgtgcctgcgtgcgagtgacccatgccgctgctgcctggattctccctgacccatgaggaggaagaatgcacgcatggacctccaggtactccgctccttccaggccgtggcagagggaacgacggtgaccgacgccgcggcggacgcccgtatcacccagcccgccctgtcgcgggccctgaaccggctcgaggacgaggtcggcgcggaactcttccagcgcgtcggacgcgtactgcgcctcaccccggccggacgggtgttcaaggagtacgtcgacgcggtgctcgacagctacgaccggggccggcgagccgtggcggagatcgtcgacccggacgcgggtgcggtgtcgctggccttcctgcacaccctgggcacctggctggtgcccaggcttgtcacggacttccggcaggcgttcccgcaggcccggttcgagctgcaccaggacggcgagatcggactgacccggcacctcctcgacgccaccgcggacctgatcatcaccagcagcgagcccgcccaccccctgatcacctggcggcgtctcctggtggagccactacggctggccgtccccgcccggcaccggctggccaggcggcgccgggcccgtctggccgaggtggccgaggagccgttcatcctgctcaagcccgggtacgggctgcgcggcatcagcgagacgttgtgcctcgaggccggcttcaccccgctcgtcggcttcgagggcgaggaggtggagaccttgcggggcctggtcgccgccggtctgggtgtgtccctgatcccgtcgtcgccggacagcacgacgcccccggactccccgatccgctacctggagatcaccgacgtacacggtgcccgggacatcggcatcgcctggctgagctcccgtgccctgccaccgatcacccggcgtttcctcgatcacgccctgaagtcggccgccgcacccgcggcttcacaagcgacctcgcgcgcctgacctcgctgccgagtggagcggaagccaccgcgccggtccccgatccgctcaggatcaggactggtacggctgctgcggttgctgcgactgctgcccgtacgtctgaccgccgtggccgtgcgcgccctgcgcctgtagccgctccgcctgctccttggtcactttctgctccgcaccgcagaaggtgcactgcgtcgtgtacttcgtcgagaacgggaacagcggcacgaagaaaagcgtgaacttcgtgacgcgcttcctgagcgtgtgcgcggagggattgccgcaacggccgcacacgagcgtcagcatcgcgagctggtacaggtatcccctggtgccaaagatgatcatgctggtccctcccgggtcaggccacggtgccggtggcgactgtggtggcagtggcggctgtagtgaccgtggtggcagtgatggcatctgaactgccggccgtggccagtaggttcccctgacggccggccgcctggccaattccgtcaggacgcgtcgacctgcgctgggaggacgagtctcccagctgggaggaagccggtcctggtacaggccctgtcgacctttgactcggctctgcggaccgactactttccaaatagtagaccggtcggctagtaattcgtcggaacatcctcacccctttcggagaagtcaccatgagctctcaaggccagaaggtcgcggtcatcaccggcgcgtcgcagggcatcggcgccgcactggtcgacgcctaccgcaagctcggctacgccgtcgtcgccacctcgcgcacgatcgcccccgtcaacgacgcgggcgtcctgaccgtccagggcgacatcgcctacccggccaccgccgaacgcgtcatctccaccggcgtcgagcgattcggtcgtatcgacaccttggtcaacaacgcgggcgtcttcgtcgccaagcccttcaccgactacacccaggacgactacgccaccgtgaccggggtgaacctcgccggcttcttccgcatcacccagctggccctggagcacatgctctcccagggcggcggccacatcgtcaacgtcaccaccagcctggtcgacaacgccgactccaacgtcccctccgtgcttgcctcgttgaccaagggcggcctgcagtccgccaccaagtccctcgccatcgaatacgccacgcgcggcatacgcagcaacgccgtctcgccgggcgtcatcaagacgcccatgcattccgaggagacgcacgaggcgctcgccgccctgcatccggtcggccggatgggcgagcagagtgacatcgtcgacgcggtgatcttcctggagaacgccccgttcgtcaccggcgagatcctccacgtcgacggcggccagagcgccgggcactgacccacgggcacgcgcgggccgggaaaacgttcgtgtcgtcggggaacaagacgattcatcggggaacaagacgatcgtggcaccggtcccggtgcgggcagacgatcagagcaggtcgagccagtgcccggtgggctccgcagcttcgcactcgaccagttgtcgtcccgcggcttcgcccggctgtcgccccatccagcggcccaccgatcgagcggcaagccccctcagcagaaccgcacacggccgaccgccgctccaggtccggcgagggacgcgtacgaccccgccgagcggcccgtacgcaagtgtctgcgagcctgatgggcagcaccgagcagtggcagggccccctccggtcccgcacgttccacacccgccctcggccggtgcacgcaccgcttcaactggagatttcatgagtgacaagatcgccctgtcgacgtggcccacaccgctggagcccatgccccgtctggcggcggcactgggcctcggcgagaacgacctctggatcaaacgggacgacctcatcggcctgggcggcggtggcaacaaggtccgcaaactggaatggaccgtcggcgccgccctcgcggcaggcgcggacaccctggtcaccaccggcgccgcgcagagcaaccacgcccgcctcaccgcggccgccggcgcccgcctgggactcgacgtcgtactcgtcttccccggcactcccgacagcgccacgcacggctccggcaacctcgttctcgacagcctcttcggagccagggtccactgggccggagacggcggcccgagcacgatgggtgacgtcgccgacgaggtctgccggcagctgcgccgcgatggagcacgccctcatctcatccccttcggggggtcaagtcccctcggggcgcggggatacgtggaaggcggcgaggaactgcgctcccaactgcccgacgtggaccacgtcgtggtcgccctcggttccggcggcaccatggcgggactggtcggcgcactcggggagcaacgcgtcctcggcgttcactgcggggcggtggcagagccggccgccaccgtcgccgacctcgcgggcccactcacccgccgcagcatcaccccggaatccctgcgccttcgcaccgaccaggtgggtgcgggatacggagtgcttcatgagccggtcctggaagcgatgcgaaccgccgcaggcaccgagggcatcgtcctggatccggtctacagcgggcgcgccatggccggcctgatcgccgcggtgcgggacggcgacatccgcccggcccagcgcaccgtatttcttcacaccggggggctcccgggcctgttcgggcatacggagaccgtgcagcgctccgtcagcaccctgcgctcctacgaggtcgagtgagcgcgattcgtcacctgttcaacaggtgacgagctttgcacgggtcaggatcacctgtcaagatggtgacgtgaatctggatcatgtctttgtgtgcgggaacccggctctcgacttcgccgccacgctgcgcgctcggcgctcgctgcggttcgagatgttcgcgtcgccggaccgactggatgcctggtaccgggagtccggtgtcgtcgacgccgtctcccccagtcaggaggccgacgtcgagcaggcggtggcggtacgggaggccatctacgagctggtcaccgcccggcgcctcggggaggcctacgccgatgaggcgctctccgtggtgaacggcgcggcccggaaacctcccgcgacgccgcagctcaccgccgcggggcggcgaacggacgcgacgccggaagaagcgctgtccaccgtggcgcgacatgccgtcgaggtcctgagcggaccggatgtgccgctgctcaaggagtgcggcaatcccgaatgcacccgcgtctacatcgaccggtcacgaggcatgcgccggcagtggtgcggcatggagtcgtgcgggaacaagctcaaggccgcggcctaccgcgcccgcaagaaggaggcccaagcacccgcctcccgctgagacaccgcgacaccgcgacaccgcgccttgccgcatgagggcccgcaggcatgcctgacggatgagccccgttctcaaccagcacgaacacctctcgacccctggcgcatacccctccccaccaccaccgcacccccgcgacggcaggacgcgccccggggcaaaagcacctgcccggccagctgagtgtcggctacgcggaggccggtcccgcacacggccctgtggtcgttcttctgcacggctggccccacgacattcacagcttcgtcggtgtcgcgcccttgctggcggcgcggggctaccgggtgatcgtgccgtggtctccgtgaccggttatctgatcaccaaccgtgaacgcaacaagtcgccgttgccgccgcaggccgagtgggcgtggtggtaccagtactacttcagcacggagaggggtctgctcggactccaggcgaacgcccatgaccttgccaggctcatctggaagttcaactcccccacctgggacttcgacgacgccacgttcgaccgtacggcggcggccttcgacaatcccgactacgtcagcatcgtgatccacaactaccgctggcggctgggcctggccgagggcgaccctcggtacgaccgcctcgagaaccgacttgccgcaggtcccgtcatcggcgtgcccacggtcaccctggacggggaacgggatccctttactcctgccggggacggctcgtcctatcgcgacaagttctccggcccgtacgcccaccggactctgaaaaacatcggccacaacgtgccgcaggaagcacccgaggcctttgccgaagccgtcgtcgaagcggacgggctcggtcaccgttagtcggcacggaccgcaggccaggacctttgcacaggttgcgaccagccatctccggcacaaccgtggatacaggcggaagcacccagtggtcagaggccagcggccggcggcatggacacagagaccgttgagacccgttgacaccaaagacaggagcaggcagtcgtggacatgaaactcgagattgcggtggtgccggtcgccgatgtcgaccgagccaaggacttctaccaggctctggggtggcggctcgacgccgacgtcgccgacggtgaggacttccgggtggtgcagttcaccccgcccggctcgccgtgctcgatcatcttcggcaccggggtcacctcggccgcgccgggctctacgcaaggcttgcacctcatcgtctccgacatcgaggcggcccatgccgagctcaccgatcgcggcgtcaaggtgagcgaggtgttccacgacgcgagcggggtgttccaccgcgccgggaacgaggggcgggtaccgggcccggacccggaacgtcgcagctatgcctcgtacctctcgttcagcgatccggacggcaacggctggctgctccaggagatcacggagcggtttccgggccggtgaccggacccccgcgcaccgagacgcgggtgcccccgccgcaccgccgcggcggaaacctcaattcgcggccgacacctcctcaggcatacgggcaccgaggatggcgagacagttcgtccagaggggcttgaggcgcccggtgtcgttgtagagcttggcgaagagcacctggccctcgagctgggcgacaacggagcgcgcgccctcgcgagtatcactcacggcgacttcaccgcgctcccgggctccgatgatgacttcttccaccatgtcgacctgcgcgtcgaagatctgttgcaggcgctcacggatggcttcggtctggttgctcatctccagggtcagattcccgaacatgcacccggagacggtgccgcagctctgctgcccggcacgctggccggcctcggtctcctcgaagagctgccgcaggcgctggagcggctcggcctcgccgctcaggatgcgggtccactcgcggcgctgggtggcccagtgctcgtcgagaaccgcgagggcgagcgcttccttggactcgaagaagtaatagaagctgcccttcggcacgcctgcgaccttacagatctcggccgtacccaacgccgagtagccccgcagctcgatgagcgactgcgcggcggtgaggatcttctcccgggcatcactggtacgtcccatgcggcaagtatacgaccgatcgactactaatatagtagatcggtctactactgcaggtcccgccaactgtctccaccgcctctcccccgcccatgccgaccgtcagggccgccacggcctgggcaacgtgggcccagggtgagcggaccgggccgtccgatcgggcggaggagtgtcgggggatccccgcgttcatgccgtagtcctcgtgcgggggtgaacgtatccgggccgggcatggctcaccgccgcggccgcgtcgtggcgggcgacggtgaggaccgcgagcggaactgactgtcacgcggtggcgtcggctctgcccgggtcgttggggtgggactcgagaggggtgacggtgagcgtcatccacgagcgcagcggcagcgtgccgagcaccttctcgtgaagctcgtcctcgtccgcggcgcgccacacgccgatgctgcgcagctcgccgaccgggcgccacagccggaacaggttgccggtggcggccagttcctcggcccggaccgcttcggcggcacggcgccggtcgacctcggccggttcggtgccttcggggatggtggtggtgatctcgaccaggaactcacgcatgatgtttctccgttgggtgtggcgcccggctcgggccggaacgccggagacgaccgttgggagcaggtggcgtccggcgaagccgaggttgtcgatgtcgacggaccggtcgtgcgagagaagtacggcgtggggtgtgccgatcccctcggccgcccctgcggggtggcgggacttggccagggcgcgggtgccgccggtggcggggccgggggcgtcgaaggcggggtcggtcagcagccgcaggccgccggtctcgatcagtgcggtcggtccgccgaacagccgcaccgtgaccggctgccgggtgccggcgggacccctaccggtggcgtgctgtcgggtttccatgtcctcatggtgtgcctgccgccggcgcggacgccacgaccggcttcctccttgctggtaggcgcagcctctcagcgacgtagcatgacagcgtggagctgcgccaactgcggtacttcctcgcggtcgccgaagagctgaacttcggccgggccgccgagcggttgctgatcgccggaccctccctgtcccagcagatcaagacgctcgaacgcgacctgggggtacgactgttcgatcgcgaccgccgctccgtgtctctcactccggccggtacggccctgctgccgtacacccgctccctgctcgaaagggccgacgacctccagcgccgtgcccgtcggctgggcggatcggagccggtccggctcggctacgtcaactggctccccgccgacctgaccgcccgcgcctccgcggtggcccaactgcacatcgacgcctgggtcgcgccctcgcacgcccaggccgcccgggtcgccgacggcagcctcgacctcgccgtgtgctgggtgcggaacgaggacctggaacggcacggcctgcgagcccggctcatcggtgccgatcggctgtacgcggtcaccaccggcagcgaccccagcggtgtcggcgcccaggacaccgtggtcctgctcgacgacgacaccacatcctggtcgtcgtggaacgtctacgccgaacaactggcccatgacaccggcgcccgcacggtacgcatctccgacggcggcgtcacgggccccgcgttcttcgaccatgtccgccgcggccgccgtccggtcgtcaactctcccaagggccagaccacaccgctgccgccggacctggtccagcgtcccgtgatcgcgcccaagatctactggacctggtctctggtctggcgcagcagcgaagtccgcgccgcggtactcgccgtcgtcgacaccctcaccgacggcgtcggcgacctcggaatccatgccccggacgcctggctgcccgacggagacccgtacaagcggtaggggcacccgataggtcggaacaactcacagacacgtacggacgagccactcgtcgtaattgtatgcgtctctcgccggatccgggactgtggccggcttttcttcaaccgtatccgccaggcggatacgctccggaagcttgccgaatcgttcacggcgcgccacctcgacggcatccagggccttctgttcgtacggcatttcgccctcctccattcgacgcggcccgccgggggcagctcggacgacggccgcttcgacgacggccgctccgacagcgaccgagaggctgccgcgattctccttgccaggttcgactgcggcctgccggtcactcgtagccacggcaattcccctccgccggatttcgagtcaacaaagtctcatatgcgatcgatagacctacgacgcggaatccaaatggcggtccgaattcgttcggaattccgcagccttgaaccgccgggcgacgggacatcacctcttcagctggtgacgatgctcgcagcctgctgcgtcacctgtcaaggaggtgacgtgatcccgaccgcgacttcgacgcgaccgggatcgggaacgagaacgggaacaggaacaggaacaggaaacaggaaacgggaaacgctccagcgaacaaggggcggcacccgtgccaccccgccgcgacggccgcgccctaaggcaggcgccagtccaccggctgcgcaccctggcggaccaggagttcattggcccggctgaagggacgtgagccgaagaacccgcgatcggccgacatcggcgagggatgtgcggactcgatcgccgggagatccccgagcagcggccgcagattgcgggcgtcccgcccccacaggaccgacaccagcggcgtaccgcgcgccaccagtgcccggatcgcctgctccgtcacctcttcccagcccttgccccggtgcgccgccggcttgcggggggccgtcgtcagcgccctgttgagcagcagcaccccctgctcggtccatggcgtcagatcgccgttggacggcctgggcagccccaagtccgtgtgcagttcccggaagatgttctccaggcttcccggcaacgaacgcacctcgggtgacactgcgaagctcagcccgatggccatccccggcgtgggataggggtcctgaccgacaatcagaacgcggacgtcgtcgaagggctgctgaaaggccctcagcacattcgccccggcggggagataggtccggccggcagccacctcggcccggaggaagtcccccatcgccgcgatgcgtccggccacagggtcaagagccttcgcccagcctgcttcaacgagttcatgcaaaggtcgtggtgccacaacgcgtcactctactggcacacaccggggccctacccaggcatcgccgccccgcgcacggggccgtcgcacggcgctactcttcctcctcgccaaggccttcgaaccggaaggccttcgaaccggtccgacagagcacccagccggtcgccgcgaagaaggggagcgtgttgcgtccagtgatcaagtcactccgccatggtgacctgcccccgcggcaaggggcgcagccggtggaccggcgcctgccgtgacacccacaggcgcggcgccgggcggtagggacgggacgccggacggcccgggaccacgtgccgatcccaccgcggctgccggacgttcggatgtcgtcctcgccgtggactccgggggttccggactgcgggccgttctggccgcgcgcggcggcgggggcgcggctctgtcggcgccgctcgtgtcgaaggagccggtgcgcaccggacctcgcggtatcgatgccgggcagctgctggagcacctgctgcccatggcacggcagttgctggccgacgccgaggcgggcggaccgtgcgcggtggcgatcggagcggccggcttcgccaccctcggcgacgggttgcgcgccgaactgccctccgcgctggcccgggagctcggcgtaccgagggtcgccctcgccgccgacgccgtcaccgcctacacgggcgccctcggcgtccggcccggcgcggtggtcgcggcaggcaccggtctcatcgccgtcggcacggatctccgaagctggcgccgggcggacggctggggccatctgctgggcgactgtggcagcggggcgtggatcgggcgggccggtctcgaggcggcgctgcgggcccacgacggacggccgggcggctctccgcggctgctggcgcgggccgaggagaggttcggtccggtcgcctctctgcccggcaagctctatccgcgcaccgaccgcccggccgtgctcgcctccttcgcacccgaagtggccgcctgcgcaccgggcgacccggtctcggcgggcgtcctgcgcacggcggcccggcacatggcggagtccgcggccgccgtctgcccggcctcggggcatccccaagtcgccctcaccggcggcctgttcaaaatgggcgccccgctcctcgtaccactgggggaggaactggccgtccagctcccgcacgcacggcgggtgacggcggaaggcgacccgttgcacggcgccgtgcgcatcgccctcgacctggccgccggttcgctcactctcccgtgcgacgagcacatgctgtacgtggtgaccgagtgaccgagtgaccgaaaagagtgactgatccgccttgcggaaaggatgactggcgtcttccggcacagccgcaagatcagaccgtgtcgatcccttcaattccgtacgtaactcatcagacaaaagcggacggataccgctcacctgcaccctccccgaacaggggagcccaggaaaccagtaacatgcggcgccatgagctcccccactgggcccgcgtccggcctgcctgtacgaatgccgcgaccccgccagcccgggcggcaccgccgtccggaacccctggcggctcccgagggcgcgcccgcgctcgtcctcgcggtgccgggcacccccagcgccgccacgcgcagcctcgccgaggaggtcgtgagcatcgcgcgctccgagctgcccggcctcgacgcccggatcggctacctggacggggacacctccgagttccccacgcttcagtccgtgctcgtgcgcaccttcgaggagcgcaccgcccgcttcgaacaggcccgcgccgccggtatggacgtcaaggagcccgacggccccgtcgccgtcgtggtgcccctgctcgcgggaccggacagcgcgctgctgcgccaggtccgccaggcggtcatggacagccgtatcgcggccgatctgaccgatgtcctcggcccgcacccgctgctcgccgaggcgctccacgtgcgcctctccgaggccggtctggcccgcgccgaccgggccaggctgttcaccgtggccacggccgcggacggcatcatcctggcctccgtgggtggcgacgaggccgtgcaggcggccgggatcaccggcatgctgctcgccgcgcggctcgccgtgccggtgatggcggcggcgctggacgaagagggctcgatcgcggccaccgccgagcagctgcgttcctcgggctcgcagcagctggcgctcgcgccgtacctgatcggcccggagatcgacgcggggctgctggacgcggccgcccaggaggcgggctgctccgccgccgaggccctcggcccgtacccggcgatcggcaagctcgtgctcgccaagtacacgacggcgctcggtatcgccccgcagcagccgcagggcgcgcccgtccgctgacccgtacgcttccagaacgacacagggcccgcccttctcgaggggcgggccctgcggcttccggcgttccacctcggccaacgcccatcaggcagccggtcggctggtccggagcacgcaccctagacccggtcgaagaccacgcaggacgccgccggcgcctcgatcgagccgcccctgcgtggcagccccgtcgtcgggtcgacggcgaaccaggtgacgttccccgaccgctcgttcgcgacgtacaggaaacgccccgcgagggtcagcgcccgaggccaggctcctccgcacggcaccgtcgtgaccaggcgcagtccgtccttctcgaccgcgagcacggagatcacgtccttgccgcgcgtcgcggtccatacgaagcggccgtcgggcgagacgacgattccggacgggtaggcgtcgccttcgggggcgccgggcagcacgggtgtctccgcgaccggcttcaacgctccgtcggcggggtcccagcggcagacggtgaccatgggtgtcagttcgttcagtacgtacgcgcggtcgccgtccgggtggaaggccagatggcgggggcccgaaccgggccgcagcgcgatctcgcggtgcacggcgagtgcaccgccgtgcaggatgcacacccgcaccgagtccgtgccgaggtcgacactgacgatccaccggccgctcgggtcgggcagcacctggtgggcgtgcggactctgctggcgcttggggtccgggcccgcgccggcatgctggaggacagtggccccctcgtccgccggggtgccgtcggcgcgcaggggaacggcggtgacactgccggagccgtagttggcgatcaggacgtgaccggcgtgcacgctgagatgggtgggcccgctgccgccgaccgggaccggcggagcggtcagttccggcttgtcgtcctccacgcggtacgcggccaccgcgccgtcggccgtctcgctgaccgcgtagagcatgcctccgtccggtgacagggcgaggtacgacgggtcgggtacgccgtccgcgccgcccaggaccgtcagcgcgccggtgtcctcgtccacggccgcggtgagcacgccgagacctcccgccgccgtgaacgacccgatgaacgcccgtcgtcgccgcctgccgccgtctgtcacctgcgtcccctctcaccgatgggggtctccagcccgggaggccgggctcgggagcctctgggccgaccgtagcagccggtctagaccagaatctcgtcgatctagaccagaatctcgtcgatctcaccgcgcgcccgggccagcgcctccggatggtggacgtaggcggggtgccgttccaccgtctcgtacgtgcggtggaagaccggggtggcgctgccggagatcggcggcacgatccaggaccagtcggcaccgacccggcggcccttgcgctcctcgcggtccaggtgggtgaggaaacgaagggactcggtgtggtgatcggtgacggtgacaccggcgcggtcgaaggagtgcaggacggagcggttgagctcgacgagcgcgcggtccttccacagggagcggtcgctgcgggtgtcgaggccgaggcggtcggcgaggtgcggcaggaggtcgtagcggtcggcgtcggcgaggttgcgggcgccgatctcggtacccatgtaccagccgttgaagggggccgccgggtagcagatgccgccgctctccagacacatgccggccagggcgggcaccgcgtgccagcgcagtccgagcgaccgccaccaggggtactcggggtgcgtgagcgccacttcgagcacggcgtcctcgggcagcgtgaaccaacggggccggtcgcccgcgctctgcacgatcagcggcagcacgtcgaacgggctgccggggccgccgggccagccgaggcgacgggcgagcgcggtcagaccggcgttgcgcgggtcaccggtgactgcgccgccggggcgggcgtagccggcgtaccggatgagctgctcgttccagatccgcggtcctggacggccgggcgcgtcgggtgcgaacaccgtgatcagggcgcggatacggccgtcccgggtggcctcccgcaggtggtccgccgaagcctcggcgacgtcctttgcgtcccgcacgtcccggcggtcgcgtacgcacagggagtgccagtacagccgccctatgcatcgattggcgttccgccaggcgacccgggcgccgaagaccagttcttccgtggtgtgtcggtacgtccctgtctccgcgatctccgcgtgcgcggcggcgatgcggcgggccgggtcgccgaggcgttcttcggtgtggtggagggtgaggaacgcggtggcggcgcagaggagatcgtgcccgtcgtgaccgtcctggccctcgtgcccgtcatggccgtcgccttcttcacgccggtcgggccgggcgggccgggccggcccgtcggtggtggggctgccggtcgggtggtccggatgcccgtccgggcggtcaccgcgggtgcgcgccgcgccccacccgcgggcgcctgggagggtcggcccagggggtctgtgctcggactcccccgcggtgtccttgcgaccgtgcggcgcgcaccacgtctccgtgctccagccgcgtgcgcgggagggcgcgccgtgccgatcgcgcgcgtccccgcccggtcgactcgcggcactttccggcggagcgtcggccagtaagcggccctggaggcccgtgatcgatccggtaccggatccgtcggccgtccatacgccccggccccgcccgacaccggatgggtcggccatgcgcgggccctgtcccgtggcggtccgcaggccctggcccgtatcaggcggctccgcggtccgcaggccacgtcccgcgccgccggtggcgggctcgtgggatgccgggggatccgtatccgcgccgtcacggtgggcccgggcccggtcgagccagcctcctggctcctccggccactgcggccgggacccggtgcttcccgtaccagccgtattcccggcgcttccggtacttccgtcgccgtgtcggcgtgggaagttccgcatggcacacccccaagcggctccgtccgcgggccgctcccgcacggtccgcgggttccgtgctgtccgatagcggcgggattacccagccgatgccctgatccaccctccaggtggccgaaacatgtgcctcacttcaaggtcgggtcgcccggcccccgagcgcagcaaggtcaggcgcgggcgagtcccgggtcgtgggcgtcgcgcaggggtgcggtgagttcgtgcagggcccgctcgatcccgtgcagatgtgcgagcaccggttcctccgccggaccggcggccgtcctgccgcctgccgggaccccgacgcccggactcccgggggtggtgagcgcctcgacggccgcctcgacccgctcgcatgcggcggaaaggcggggatcgtgggacgcctcggggtccgaagcgatggcggcgagaccgcgcacctcgtccgcacaggtacgcagcagggcgagcacgcgtcgggcccgccgaccacgggcgcgcagcgggttgagtgggtgcaccagaggggcgagcgagaggcccacccggctcaacagcacctccagctcggccacgtgcgcggtcggatcggcggtggccgagccctgcagacgcgccgcggtctcggcggtgcagcggtgcacacagcgaagtgctcgcgctatccaggcatccgtgatgacgtgcgtgctgaccggcaggacgaacaggacggccagcacagcgccgagtgccccgactcccgtctcgacaagacgcaaggcgatcaagtgcggatccagcactccgagaaccccgtagagcagctcggccatcacggtcacggcgagcatcatccacgtgtacgagacgggggcgctgtagaagatgccgaagacgcacacggccacgagagccgcggtgggtacgggcgccccgtgcagcgggacgaccaccagcaacccgagagcgatgccgatcaccgtgccgaggacccggcggaaccctcgaatcagggtctccccacgggaggtggtgttcacgaaaacccaccatgccgcgccgacagcccagtaccaccgttccggcgacaccatctgcccggcgacaagggcgaaggcagcggctacggccgcctggaccgcctgacggttcgtcgggcgagcaagacctcggccggtgagcggagcggacgccgcgacgggcggcatacggcgctcgtagcaccagaggccgaacctgacagcggaggaagccgagagggcgagcagcgtggcgccgtacagctcgggcagctgatcaggcacggtacgcaggaactgcgccacgaagaacgccatgaacgcgaagacgccgagggaatggccgcgcggcccccatcgccgtgcgtacacgcccgcggccacgacggcgacgaaggcggcatccctcgccaccgggtgttcgtgcagcccggcggcgagagccagtaccgggaagcccacgacgggcagcagcgcggtcgtggtcgcctgtccgcgcactgtcgcgtcggcgaccgtgaacagcgcgagcaacgccgcgaggccgccggcgacagccccgacgagagagtgaccggccagaccgcacagggtcaccgccaggccgatgccgaggacagcccgggtggcgctgcgcagacgcagcaatcccgggtccggagccacgaacatcctcttccacacgttttcccgccccagatttcttcgccatggcgcccgcccggcacacaaaaggcgccgcggagtccgcagcgccatcgacctgcacatgagagcatccacaggtcctatggctcaagtcgccctctcacacatgagccattggcccaatcgacgggcaagaccggtggccgacgcagaaccattgggtcatcaggagcaggacgtcgaggcgtacggtcgaccggcccggatgcgtaaccggacggtccggccgatcctgggaacatgtccggaccactgcccgtgatcgtgtcgccgccctcgccgacgggcggacggcgcgtccgtgtggacggggagatcctgggactcgcgtacaacctgggggatgtcgccgagttcctccgtcgggccgggatggacatggagccggtgcaggtggccgtctcaccgctgatcgactggcgcggtgtggggccggagtactgggggccggagacgcgagcctgacccgggcgaggcaccacggcgcggtcagagcggcccgtctcctccgtcgacccggcatttcgcctgtcgcagcccgctctcgagttcctcgcggatgtccctgggcagatcacccgtctgggcccagtcgatgatcagttccgccacgtgtctcagcttgatgttggtgcgctgcgaaacctcccgcaggacgtcccagctccggccgggtgccagcccgcccagcacgacgacgacaccgatcgcctggtcgatcgtggcgtgcgacagcaccgcctgcttgagctggaggttctcatcctccagtcgggccttggagagttcctgctcatacggttcctgggccgcagggcgctcgtatgcctcggatgtcaacgttgcctccgggggtggggaagtagcgtcaacctgttactgccgcagatgcccgtcgacctccaggacattcccggcgggggcgggaagttacccggcagggtgaacgagacgcccctgccccctgtccggatcgacccgctcgcctcgagccgagccacgggtacggccgagccatgggtacagtcgtcgaagatcacgccggacggctgggaggccaacggaccatggccgtcgacgaactcgacacccgcatcctgcggttgctgctcgagcagccgcgcaccagcgtgcgcgagtacgcacgcatcctcggcgtggcccgtggcacgctccaggcccgcctcgaccggctggagcgggacggagtcatcaccggcacgggtccggccctctcccccgccgccctcggccacccggtgctcgcgttcgtgcacatcgaggtcacccagggccatctcgacgacgtgggcgacgcgctcgcggccgtaccggagatcgtcgaggcgttctcgatcaccggcggcggcgatctgctgacccgggtggtcgcgcgggacaacgggcatctggaggacgtgatccagtcgctgatcagcatgccgggcgtggtgcgcacccgcaccgaggtggcactgcgcgagcgcgtaccgcaccggctgctgccgctggtggagtcgatcggccgcacggccgccaagtgatcattggcatcctggacaccatgagcactctcggcaccacgtcggtcgtcttcgatctcgacggaactcttgtggacagcgagcccaactattacgaggcgggccggcacctcctcgccgagcagggcgtcacggacttcacctgggcggaccacgagcagtacgtcggcatcagcacccaggagagcctggagctgtggaaggagcggtacggcgtcgaggccccgctcgacgacctcctcgcggacatgaaccgccgttatctggcgctggcccgcgcctccacgccggtctacccggagatgcggaagttcgtggaactgctggccggcgagggcgtgccgatggccgtggcctccggttcgtcgccggaggccatcgaggcgatcctgacgggcacgggcctggcgtcgtggctcaccaccgtcgtctccgccgacgaggtcgcccggggcaagcccgcccccgacgtcttcctggaggcggcgcgccggctcggggtgtccccggcggactgtgtggtcctggaggacgccgcccctggggccgcggccgcgcacgccgcccgaatgcgctgcatcgcgatcccctacgtcgccgcccaggccgacgacccggcgttcgcgaccgcggggctactggtgcgcggcggccagaccgagttcaccgcgcgggcggcgtacgagtggctggcgcgctcgacaccgtcttcctgaggtgcggcccgtagggcgttgacgtcggcttccgcgcccctgagccaggccggtctccaggtctccaggtctggcgtggtgcccggcacctcggcgtcgtgagtcatccgaccgccctcgtccccgcggtcaccgggccgggggcatcggacaggtcgtggtggatcggggtcggtgagccggtcagtggtacgcccgtcccgccccgtcgggccgcgacgatctctgccgcgatggacagggcggtctcctcgggcgtacgggcgccgaggtcgaggccgatcggtgagcgcagccgggacagttcacgtggggtgaggccggcctcgcggagtctgcggtcgcggtcctcgtgggtccggcgcgagcccatcgcgccgacgaacgcgaccggcagccgcagggcctccacgagcagcggcacgtcgaacttggcgtcatgggtgagcacgcacagcaccgtgcgctcgtcggtcggcgtgtcccggaggtagcggtgcggccagtcgaccacgaggtcgtccgcctcggggaagcggacccgggtggcgaagacgggacgggcatcgcacacggtcacgtgatagccgaggaacttgccggtgcgcaccagcgcggcggcgaagtcgacggccccgaagacgatcatccggggcggcggcacgctcgactcgacgaacagcgtcagtccgcccgggcagcgcgctccgctctccgagacctcgaccgtgccggtgcggcccgtgtccagcatcgcgcgggcctcggccaccgccgtccggtccagccggggatgcccgtcgagacctccttcgtacgatccgtccgggtggaccagcagggcccggccgagcagttcggcgggcccccgggacacgcggacgaccgccgcggcctccccccgggcggcggccgagagggccgccgcgaacacggtccggccaggtgcgtccacgccgaccggcgtgaccaggacctcgatgaccccgccgcaggtgagccccaccgcgaaggcgtcgtcgtcgctgtagccgaaccgctccaggacggtggtgccgtcctggagcgcctggacgcaactgtcgtacaccgctgcttccacacagccgccggagacggagccgatgaccgtgccgtcggagtcgacggcgagggcggcgcccggcgggcggggcgcgctgccgccgacggccacgaccgtggccacggcgaagccgcgcccctccccgacccagcggttcagctcctcggcgatgtcaagcactcctggatccctccgccgccagcaggacacggtcgggcctgatcgggagctgccggtggcgtacgccggtcgcgtgccagaccgcgttggcgatcgccgccgcgccaccgaccacgccgatctcgccgatgcccttgatcccgaccgggtcgtccgggtcggggtcctccacccagtccgcctcgagcagagggacgtcggcgttcgcggcgaagtggtagcccgcgaagtcggcgccgacgaggccgcccgaggaatggtccctgacggcctcctcgtgcagcgccatggacagaccccagaccatgccgccgaggaactggctgcgcgcggtgagcgggttgacgatccggcccgcggcgaagatgccgagcatccgccgtacgcgtacctcgccggtggtggtgtcgaccgcgacctcggcgaactgcgctccgaaggagtgccgttccttcttcgcgaggccgccgacggcctcggtggtgtccgaccgtgcggtgatcccctccggcggaatgccgccgcccagggccagccgctcccgcagctcgcccgccgcggccgtcaccgcccaggcccaggagcgggtgcccatcgagccgccggcgaacatcgccggaccgaggtcgctgtccccgatgtgcacgcggacgcgtcccggctcggcggccagcgcctccgcggcgatcagggtcagcgcggtccgtgctccggtcccgatgtccgccgcgttgatccgcacggtgaaggtgccgtccgcctccgcggtcaccgccgccgtggacgggccgacccccgaggggtacgtggcggccgccgtaccggtcccgagcagccagcgcccctcgcggcgcacgccgggacgcggatcgcggtccgcccagccgaacctgcgggcgccctcctcgaagcaggcgagcacattgcggctgctgaacggcagcccggacacagggcccgccccgggttcgttgcgcgcgcgcagggcgatcgggtccaggccgcacttctccgcgagttcgtcgagcgccgactccagcgcgaacgagcccggcgcctcgcccggcgcacgcatccaggtcggggtcggcacgtcgagccgtacgaggcgatgagtggtgcggtgcgcgtcggcgtcgtacagcacacggccgaggacggcgctcgactcgacgaactcgtgcacggtcgacgtgaggctctgcgcctggtggtcgaaggcccgcagccgcccgtcggggtcggcaccgagcctgatccgctgcgccgtggggctgcggtagccgaccagcgagaacatctgccgacgggtcagtacgactctgacggggcggtgcagaaccgttgcggccatgacggcggccacctggtgcgggcgcacccccttggacccgaagccgccgcccacgtgctccgaccgcacccgcaccgaggccgggtcgagggagaacagctgggccagctcgccggccacccacacggtgctctggttggagtcgacgacgtcgagccggccgctgtcccagcgggccgtcgccgcgtgcggctccagcgggcagtggtacgcctccgggagtggcgtactccgcgtccacgacgacgtcggacgccgccagttcggcctccacgtcgcccttcaccgcctccgcctgcacgagcgggctgtcctgcggcgtgtacagaccgggatgcccggcgaagaactcgacgtcgtgcggctcctcgtcgtagcggacgaccagtgcctcggccgcttccctggcctgctccgaagtctcggccacgacgagcgccaccggccagccgacgtacggcacccggtcgtcctggaagatccccagggccgggtcgggacgccccacgatgccgatgtagtcggtggtgacgcgcggcgcgttggcgtggtgcaggacggcgaggacacccggcatcgcgaggacggggtcggactcgaccgtgcggacacggccacgggcgacggtggacaacaccagccagccgtgggccagttcgtcgtacggaatctctccggcgtagcgtgccgctccggtgaccttgtcgcggccctcgacgcgggtgtgcgcggttccgacggcacccgtcgcccgggcggcgccctgggtggtcgtggtcatcgggcggcctcctcggtgagttcggtcaacacggccacgacgaggttgcgcagcagcggcaccttgtatccgttgtgcggcaggacctcggcggcgcccagttcggcgtccgcggcggcggcgaacgcctcggcgctcgccgggcgcccggtcagcgcccgctcggccgtccgggcccgccacggccgggacgcgaccgcgccgaaggcgaggcgcacctcgcgtacgacgccgtcctggacgtcgagggcggcggcgagcgagccgatcgcgaacgcgtacgacgcccgttcgcgcaccttccgatagcgcgagacggcggcgaccgggctcggcgggagggtgacgccggtgatcagcgcacccggcggcagggcggtctcccggtgcggggtgtcaccgacgggcagatagaagtccgcgagtgccaactccccttctccgtccgcggtttcgtacgagacgaccgcgtcgaaggcggcgagcgccaccgccatgtccgagggatgggtggccacgcagtgggcggaggcgccgaggatcgcgtggttgtggtgctcgccctcgacggcggggcaaccgctgccggggagacgcttgttgcagggttgggcgaggtcggtgaagtagccgcagcgggtgcgctggagcaggttcccgccgacggtggccatgttgcgcagctggcccgaggcgccggccaggacggcctgcgccaacgccgggtagcgacgccgcacgtcggggtggacggcaagatcgctgttggtgacggtggcgccgatgcgcagtccgccttccggggtcggctcgacgaggtccaggggaagctcacgtacgtcgacgagacggccgggccgctccacgccggacttcatcaggtcgacgagattggtgccgccgccgaggaagcgcgcgtcgggatcggcgccgagcaacgcgaccgcgcccgggacgtcgaacgcccgctgatagtcgaactccctcatgccgcggcccctttgacctcggccgcctgagcgtcggccgcgtgcgcctcggccgcccgcgcgaccgcctggactatggacacataggcaccgcagcggcagaggttgccgctcatccgttcgcggatctcgtcggcggtgagcggtggcgctcccgcttcgggacgtacgtcggcggtcacggcgctcggccagcccgccgcgtgctcctcgatcaccgcgatggccgaacagatctggcccggggtgcagtatccgcactggtagccgtcgaggtcgaggaacgcctgctgcaccgggtggagttgctcaccgtccgccacgccttcgatggtggtgatgacgcgcccctcggcggccaccgccaactgcaggcaggagacggcccggcgtccgtcgaggagcaccgtgcaggcaccgcactggccctggtcacagcccttcttggtacccgtcagatcgagccgctcgcgcagcgcgtcgagcagggtggtgcgatggtcgacgggcagcgtgtgtttctccccgttgatgttgagggtgatggcgctggacgtcgatggggccatggtcagccttctttcgcgttcgtggtgcgcgtcgaagtcgaacgggagcctcaggggagccgaaggggcggtccctcaattggagaggtacgagagaatgccggtgggcgatcggttccggccatccccacgggccctgtttgccgctatggtggcgctaagcggacagctgtccgttacatggaaaacctaacggacagctgtccgcttagcaagggcggcccggccgcgacttccggagggagtctcgccgtgatgccggaaggaggacgggtgcagcagaagaaggaagcaccgctgcgctcggacgcgcaacggaatcgcgagcgcatcctggaagtcgccctggcggagctgacgtgctcggcggacgccccgctcagcgcgatcgcgaagaaggcgggcgtcgggcaggggacgttctaccgcaacttccccaaccgcgaggccctcgtcctggagatctaccgctacgagatgcagcaggtcgccgacaccgcggcccagttgttgcggacccgcgcaccggacgaggccctgcgggagtggatggaccggctcgcccagttcgccatggccaaggcaggcatggccgaggcgattcgcaaggcgaccagcgcgccgggcagcccggccaaaccggggcacgaaccggtgaccgcggccgccgcgctcctgctggacgcgaacgaatcggccggcacgatccgccccggggtgacccccgacgacttcatcctcgccatcgccggcctctggcagatcgacccgcacggcgactggcagccacgcgccgcccgccttctggacctggtcatggacggcctgcgcaccggggcacgcgggcgctgagcgtcacgcccccgcggccccgggcccggcccggcccgcagacgatccatgcggccgcgccgaccgccgtcgtcagggggtccgtgtctcgtcgaagctggcgtagtagaccgcggccatgtcttcgtcggcgtggccctgggcggcggcgcggtggaggcgttcggcggaggcctcggctccgtcgaggcggacgccgtgctcctgtccggcctggacgatcaggcgggcgtccttttcggccgtgctcacggcgaagctggccggggtgagaccgttgttgaggacgaggtcggccttggcgtgcagatagcccatgtcgagggggccgccggcgatggcgtcgaagaagttctgcgggtccacgccgagggccttggccagggcgaggacctctccggtggcgttggtggcggcgatgacccaactgttggccacgagcttgaggcgggtggcactgccggccgcgccgtcctcgccggtccacagcgtgcgggagccgacggcgtcgaacacgggcgtcacggtctcccggctctccgtggggccggcggcgaggacgacgagctgtccggcttcggcgggctggcgggtgccgaggacgggggcgtcgaagaaggccagccggtgctcgcgggcgaagtcggcgaggccggtgagggcgtcgaggccggcggtggtcgactggatccaggcggtcccggggcgcagggcgggggcggcctggcgcatgacgcccaggacggcgtcaccgtcgtgcagcatggtgaggacgacgtcggcgccctccacggcctcggccggggtgtcggcgatgtgcgcaccgtcggcggccagcggctcggccttggcgcgggtgcggttccaggcccggacggtgtgtccggcccgggcgaggttgcgggccatcgccgctcccatgattccggtgccgaggacgctcacggtgagggtgtcggtcatgacgtcagccttctgtgctgggggtctgcggggccggcgcgtctcaggatgcccgggcgcaccggctcccaggagtgtgcccctcacaagcgcgctttcccggccacggcacggacggggtcgtcacaacaccgcgacgccgggcccacgctgactgagggacgtgggttcggcgtcgcggttgatggtgggttacttgttgtggccggggaccgggctacttcttgtagccggtgaccttggcgatccaggtgatgaagtcggcggcgtcggtgttggcgccgtggccctggtcccagtagtagagcgtgtcgacgtcgtcgccgagctgttccaggctcgcggcgaggttgccgacgacggacagggaggtgtcgctgtccttggtgccgacccggatccaccagtgcttggaccggtgggggttctgctccttgacgaggtggtacatcgggttcatcagatcgagcttggtgggaaggtcgctgtccagccgggcgctgccgcccttctcgtgccgcaggctgtacagggtgaagtggcgggcctgggtggttccggtgccgaactcgttgttctcgcccgcggacaggtcgaacgcgtcgaacgcgggcgtgtccttcttccgcgctcccacatgggtcaggaagtcggcccaggtgaaggtcgcgacggtcccgtcccaggtgatgaacgtgttcgccgccagatacgtcgaccgctccgtctccgacaggcccttgaggtaagtggtggcggacggctgaaggtaggtgcgcagcaggtagtcgtccagattgcgtgcggtcagcgcgccgaagcccttggcgcgcagcctgagggaggcctggtagtcggcgaaggcggtgctcagttccttggagacgctctggtcgacgagtgtgccggtgctcagcttgttggcaccccagttccactcgtaggccatgtcggcgtgctccagatccgtgatcgggcaccagtcgccgctggcgaagatcgcgtcgctggcctcggccgccccgagatccttcaggtagctgtcgtagagggggctgtcgccggacgcgcccagcagcgccgagagcgcgccgcccgcgctggtgccggaggagacgatccgggccgtgttgccggggatgcggcccttgttgaagcggacgtagcgcaccgcggccttcaggtccacgatcgcggccggtgccgtcccgtagtacgtgccactggaatccgtcagtgtccgcccgcgcgcacccggctcgacgaccacatagccggccgccagggccagcttgccgttgttgaccatctcaccgccggcattcacctgcccgttgccgccggactgcacctcgcccgcacccgtaccggccgacgccgaggcgctgggcgacgcgctcgcgccgccgccgggcatgccggtcatcgcggcgccgcccaccccggtcgcgtccgccaccgacgacggcatgtagccgcccaccgagttcgcgaacaggatcggcgcgttcgtcgcatccaccgccgtcccgtcgatctcgaccggaacactcacattcaggctctggtacttctcgtccaccggcttggcgacataggtgatcgccttgtagaagtgatacttgacctccttgtcacccccgtccgtggtgatggtcgtcgtcaaaaccgtgaaagcgtccttgtcgaaaaccaacgcgtccgaagaatccgaggacttggaaccggacgtacccgacgcctgcgcgctcaaggcgaatccgccggccgccacgacgccggctgccgcgccgactcccatgacgacggtcctgcgcttcattgccctgtgcttcattgatctctcccattcacggccgcgctctgtgctgatcttgcgcttgcgaacgtaaaagacccgacgcgatattgtcaacaatcctgtcgacgttatcgcggacgcatatgtaattcatcgcgaacacacagcatttccatggctgcgccattccctcagcggacggagggaatatgacggcctcttgtcagcgggagcgcggggaagtcccgggccgtggcggtcggtcaggtgtattgacccgcattccgagaaggaaccgcgtcacacgcgtgcgccgcaccaggagctcgtagaccgacagggtgacagccagggagatgatcacgatcaccgcgtattcgacggggatcggggcgttccagcccacgacgaagtacgcgacggccacgacgacgggctggtgcagtacgtagaccggcagcacggcggcgcccaggtaggcgtacacgcggtggcgcccggaagagagcgggtcgggagtccggccgacggcccgcgccgcgcggcgccggtcgaggtggccgaggatggcgacgaccaggcaccagccggccgccccgaagaacgcgcgggtcgccatgcccagggcggtcatctcggtgaagggctcgtccgcgacggcgaagccggggccggacagggcgaacaggacaccccccagccggccggccggcaccgcggcccggcgcatggcggtgcggacgcggtcatcggcggcgagggcgcagcccgcggcgaagaacaccagataggcccagcgatgccagccggcgtagtcctcctccaggccggcgaaggcgcagagcagggcgagcggaagcgccggcagaaggatcgccccgcggacgcggaaggtggcctgcgccagccggtcggtgacgggtcggaggcgatccgccgcgagcacgcggaacaggaacgccagcatcagggagaaggcgagcagcagcaccacgaaccagaggtggccggtctcgaagtgctcgccctgcaagaggaaggggaactcggcgagttcgacatgcacgtcgtagaagtgagggaggaaggcgaggtaggactcgtcgtagccggggtccgcggagcgcaggcgcagccactgcggcagggggttcaggacgagggtggcgaagaccagcggcacgcccaggcgcaacaggcgttccttgacgaagcccgccgcgccgcggcggcgcagcgagtaccacgagcccaggccggagatcaggaacagcaccggcatcgcccagacgaccgcgaagccggccaggatcatgatgacttgcgtggtctcggagttcttgacgtagtagtcgtcgtccgtcgcgaagacgagggccgagtggaagaagatcagcccgaacaccacgagcatccggatggcgtcgagctccggacgccgctccggcagcgcctgccctacctgttcgatgcgggtcgccatgaccggtgcccctcccccgactgccgcctgcaccaccagtgttggggggcgagcgcgccgggcaccaccccccggcgtgtccggcgcgtcagccgcgtgccacccaggacaccgaccgcggacctcgggtggcgcgtgcgaacgcggcgacgtgtgggggacgaggaatcaagcggaagcatccgcgagagggagggcgtcggaggacggtcaaccggtgaggatggcgatgccgtccccgagcagcttcagcccgatcacgaaacacagcaccgccatcacggggatgttgtgctgtgcggcccagttcttccagccgtcgagcgtgttccgtgctcgctctcccgcgatcaggaagaccgccagcggcgccaggatccccagagacgcgatgaccacgaacaccgccagcgccccgatctgctgccccaacggaatcccggacgagctgatcgaggcgctcgcggcgatggtgaacgtggcgttcttgatgttggccgccgacagcagcagcgcgagcccgaagatcttgactggggtgaagctgtcgatcgcggccatccacttcggcagtcgcgcctgggagacgtccctggggcgccggtgccacagccggacaccgaacagcgcgagcagcactcccaggcccagcttgagcccccccccgacccaggtggccggctgcccgtggccggaagctccttccgacccgccgacatcgccgagcaccttccccatgtacctgcctccggacggcgataggcggccgaggcgaacaggcatgcagccggcgaccgccggaacgcccactgcaacgtgcccccacggacatcatcgacggcagccgccccggcggcgcgatgcgggggacgaacgggtgatccgacccgacgggtatccgttactggtgggggatcccgcgcacagggtgcttgctcatgatggagacccggttgaaagcgttgatggtgaccgccacccagatcaccgcggagatctcgtcgtcggtgagaacctggcgggcggcgtcgtaggcgtgctcctgcgcggtggcgtccgcggggtcggtggtcacctccgccagggcgagggccgcgcgttcccgtgatgtgaacagttcggtgtcgcgccacgccgccagcacaccgaggcgctgggtagtctcacccacccgcagcgctgccttcgtgtgcaggctgaggcagtacgcacagccgttgatctgcgacacgcggagattgatcagctccacgagcacacggtccagccccgcgtcggcggcgaccgcgcggaccgcctcggaggtttcgaccaacgcgtgataggccttcgggctctgcttgtcgatgaagacccgcgtgccccgcgtgcccacgggacctgctgtcgtgtcgctcaacgtgaaactcctcggtgctgcggcgtcggcttttggcgcggccgtctcctcggccacgggaatgttcgcacggccgaggaacgcgtcacccgcggtcggcggcgcccccggtcctgtccgcgtccagccgcccgacgtgcgccacgttctcccggtcgtcggcgtcctcgccggcctcggcggcgaaccaggcgtcgaggatctccctgagcaggggctgggacgtcagccgcaggctgagcgccagcacgttggcgtcgttccagcggcgtgcgccgtccgccgtgtacgcgtccgtgcacagagccgcccgcacgccgggcaccttgttcgcggcgatcgacgcgcccgtgccggtccagcagcacacgaccgcctggtccgacgtcccggtggcgacctcccgggccgccgccgccgagcacgccgcccaccgcgtgtcgtcgccggggcgcagcgcgccgtgcgccacgacctcgtggccgcggccgcgcagttccgcgagcagagagcgggccacgggttcgtccatgtccgaggagacggagatccgcatgcctcggagactactcagccgacgagctggacgcctcccacttggccggtcacgaaccggtccagcgccgaggtcagctccgcgggcttctccaccggcagttcgtggccggcgtccacgatccggaccaccgcgtccgggtagtccttcgccatccgcagcatctgtgagacgggcaactggatgtcgtagtagccgtgcaccagcagggtgggcatccggatctcgccgacccggtcgaggacgtcgaaggaccgcatggccgcgtagtacgtcatgaccacgtcccgcggcgtcgccgaggaggcccggatgtactcccggacctcctcgcgcgggtgaccgggggcgaacgcccgctggatgttggcggcgacgaacagcttgaacggcaccagcgtggacgccgccatcagcagcccccgcccccggctgtaggtcatccggctgatcgagttcaccagcaccaggcgctcgatccgctcggggtgggcgagcgcgagggtctgcgcgatcatcccgcccatcgagtggccgacgggtatgaaccggtcgatctccaggtggtcgaggagagcgatgacgtccccggccagctcgtcgatcgtccgcgccgaacccccgctctccccgtgcccgcgcaggtcgagccggaccacccggcgcttgtcggcgaagtgcgccatctggtggtcccagcggtgccggtcggccgtccagccgtggatgaacaccagaggcacaccgccgtcaccgtcgtgcgggccctcgtcgtcgtacgtcattcctgcgccgtcgacagcgagctgcggcatgggtcgcctcctggagtgcggtccggttactgacgcgtacggtagtcggccgctccgctgccgtcaccgccgttcgcccaggaagtcgagaatgtgaccgaacacgtcgagggcggcgccccggccgaggaacgtgtcgaggtgaccgtagccgggaatctcggtgtacgagacgtccaagtacggctgcctgcgcgcgagtacgtcgtgacagagcttctgggagtcgagccacagcccgttctcgctgcccgcgatcagcaggaccggggtgtcgatacggccggccgcgtccagcgcgttctgcggcaactcccggtagcggtggtcggtgtcgtgccagcggaccacgctgcgggccagctcgatccggcgcagatgcggcaggatccacagcggcgcggggcctagcagctcggcgagccggtcgtgggtggcctcggacaggtgctcgtgcacgaacagcgaggcgcccgtcccccacgccgagttgtgcaggatctgacaggtcgggtccgggcagctcgccttgcgggaggccagtgcgaacagcggcgtgtacttcgaccagaggcccaccttgcggaagtcgaccgggatgtgatcgatccgggttttcagcagctctccggccaccgacatccgcagcgaggtccggcccgcgagcttcggcgtcaggaacacgccctgcgacacgacgcccgcgagccccggcaccagccccgccgtcatgctcagcgacagcgtgagcgagccgatgcagtgggcgaccacgaacaacggccggtcgccgatgcgcccgcggatgtgggagacggccgcggggatgtcgtacagggcgacgtcgtcgtacgtgtacttctggccggtctcgttgtacggcagccggcaactgccgcgccagtcgagcagccagggctcgtagccgtcgtcgaggagggcgtcgacgaggttgcgggtctcgggcagcaagaacatgtcggcggacgcggtgtgtccgtgcaggagcagcaccgcgggccggtcgggctcgccgctgtcgacgcgggtcaggccgagccggaccccgtcccccgcgcggaaggggatctcctcgacgcgcgcgggatcgaggcggtggtggagcgggcgcagggtcgtggtggtcctgaccctgcggagcgccggcctggtggtggagtcggtcgtcctgaagatcatcggttgcgctccgtgagggtcgggttgcggcgcaggtcgagcaggtccgcggcgacccgggcgaaggggccgagcagaccgcggcccacctcaaggccgaaccaggcgagccaggtcagcttggcggcccgcttctcctggctggtcaggcgcgggtcgaccttgatgccgtcgatctggtcgcgcacatagctgtccgccggtacgacgacctcgcccgtcagtcgcgccggttcgcccgcacggccgatctcgacggtcagcgcgcgggtctgccgccacacgtcgcggcgggcccgggcgtacttgtggccctcgagccaccagtggccgccgtcggtgtcacgcaactccagccggtagcgcaggagttgatgtcgcataccgtgctgttccgggatgccctcctcggggcggatccagacgtcaccgcgctccaccgtcagcggctcggggtgcaccgccgcgcacaccagctcgccgctgacgtccacccggcgctccttcaccagctggtacatgctcgcgatggacagggtgagcgccatcgagcagggggtgtcggcgggggcgccgaccgggccgacgccgccctcggtcctctcggagaaccacaggtacggctggtcgtccttgtgcggcagccgggcgaggccgtcgcgggccagccgctcgaacgtcctgagctgcgcctgggcgtcgtagcgggccgcgggcccgagcccgagcgcctcgacgagcgcggcggtgcggtcgtcgtgggccgccgggcccttcagtgtcgcctcgcacagcttgagggcggtggggctccgcaacacccttgtcaggaaggcgagttcgggcaccgggtcggcctccaggcgggccagggcgtcggtgcgccactcgtcccagtcctgtacgcgcacgtgcatgccgccgagcgccatgtcctgtacgacgtcgtcgagggtgttgggcacgccggtcaggttgtagtcgtagccccaggcgtcgggttcgcagatgacgccgaccgcgacccggctcacccagtccaccggggccgcgttcaggtagcggaacgcgggcacggtgcggaagcggccgaaggccgagatgaggccgctgctgaggtcctgggggttgtaggcgccggtcctggtgtggccgccgatgccgcccgggcgcatcgccgtgaccagcagaccgtggtcgcgggctcgccgcagcgcgacttcggcggtccacttcgtctggtcgtagcccgcgacgagccggtctacgcgggcgagcgggtcgtcctcgcccatggcggtgatgccgacctcgttgaagaccgcgatcgaggagatgtggtgcagcggcttgggccggccggtcgccgccagttcggccagggtcagcgcgccgaggacgttgctctgccgcagcgaggggtagccgcgcaggaagtccacggccgccgccacgccgacgacgctgtccagctcgtgggcgagggtgttccacaggtcgtcggacaggccgaggcgcgggtgccggatgtctccggggagcacggtcacccggcggcggacctccgacgaccagggcagctcgtagcccttcagcgcctggcccagccgggcggtggccgcctcctcgtcggcggcgcggaccaggcagtagacgtgggcgtcgctgtgccgcagcaggtcgagaagcatgtggctgccgaggaagccggtcgcgccggtcagcaggatccggcgcggcggcagcggctcgggcgcgccggtccagggcaggcgatcggcgagcgcgaggtcggccaggatctggtcgaggtcctcgcggcgggcggtggagtagggggcgtcgccgctcccgggcggcggggtggccgccaccgccggtggggtgcggggggacgggacggggaggccgctcggggcgggcgccggacgggtgcccgcggcggagagcgggaggaggcccggggtcgcggcgacgccggccgcggtggcaccggccacggcggcaccggccgcagtggcgccaatcgcggtgacgcccgtcgcggcgacgccggccgcggtgggctccggggtcgccggagttgctgagtgggcggccggggcgccgccggccgacagccaccgccgggcgagggtgcgcggccgggcgtcggcgaacacgtcgtccagggcgatctccatgcccagctcgcgttccagctccgcgacgagttccacggcgtgcacggacgtgcccccggcgtcgaagaagtcactgtccggcgacaggtgccccccaggcagatagcggcccgcggtggcggcgacggcgacggcgaggccgtccacatcgagcgacggaccggccgtcggaccggcgccgggccccgactccgtaccgctgccggtcggctggggcgcggcggccgtcatgaccttggccagcaggtcgctcacgctgagcccgccgccgccccgttcgatcgactcgccggtcgcccgctgtccggggtacgccgacgcgccctcgttcacctcacgcatgagaacccttcacggtgtgctgtgtcctttccctcactgctgctgccaggaccggaaggcccgcagttggtccggtgtgaccacggtctccagatacgcgtcgtcctggtcaccgccgccgagcgcggcgaccagacgacgggccggaacgttgcgcggggtgcgctccgccgtcagccgtaccttcgcgcagcccagttcctcggcgcggtcggccagccaccgcaacaggcgctcctcgacaccccggccgagcgcccggcagctcatcatccaggccagtacgtcgagttggccctctcccgggcggacggcgagcaggccgatctggccgtagtcgccgaaccggtcccgggccgcggccgtccacacctcgccgcactcccgccaccgggtgagatcgccgccgtcggccgaccgggcgcggagagtgaactggttggtacgacggacgagttgctcggcccgctggacgtcggccgcggacagggcccggatgtctacctccagctccagctgggcgaggaactcttcgaaaccggcgtgttcgcggacggcgtcccgctcccgctcctgctcgtagaaccgtgcccgcagcccgtcctcggccgtcgcagccgccgggaccagcggccacaaccggcccaggaactcgtccagttcggccgtcggcgggcaggtcaccgacagcacctccggcaacgcggaccgcacccccgcgatctcgaccgggttgtcgtcgaggaacaggaaactgtccgtaccgaggttgagcgtgcgcgccgcctcggccaggcgacccgacttcgggccccaggcggcggagagcacgctgaagtgctccgccttcagcaggctgtccgggcggtccaggacggcccggaccgtgtcctcgtcgttgttgctgaccagcgccagcagcgcacccgcggcacgccactgcagcagcctgcgcgccagcagggcacgcggaccggtcaggtccaccgcctccgggccgatctccccggcgacaccgccccacagggtctcgtccccgtccaccgcgatcaccttcggcgcggggcgccgcaccgctcgtacgacgtcggccaggcgcagggccaccgccgcctggaagtccggggtgaaggggaggtgggcgagcttctcggtccgttcgtcgaagcgttccccgacggcgtggtgccgggtccagtcgtcggggcccagcaccgcgatgccgggcagcccggccagctcggcggcgacctcgctgtcccagcgctcgaggcggtcgtcggcgcgcgcggacggcgggaagccgacgatcagcggcttccgggtccgctcggacagggcccgcagcgcggccgggtactcggtgcggagctcggcgagcagcgcgtcgtcgaccggcccgaaccgttccaggtccgccgcccgcagcagcaccacgcccaccgccgtggccgggtccgcgaagacgccggaaggatcccgcaggctcgcgagcacatggtggtacggcgcctccgcgaccgtcacaccgccgtcccgtgcccccgccccctcgttgcacgccaactcgcacatcagcggcagattgcccagggcgaaggtggcggcgacggcgagcggacgcggcgggacgacagcgggctcgccggcgggcgggacttcggtcgcgggcgggacttccgtcgctgccggcgcttcgctcaccgccagggcttcggccgcgggcgggacttcggacgcgaccaggacttccgtcgctgccggggcttcgctcgcggccgtcgtacgcaccggtgccgtcggatcctccaccgcccgggcgagcagccgcaggaactcctcccccaggtccgtggtggccgccgcgtccaggatgtcgaggttgtggtcgagccggatccggcccgcgtccggcgtcatggtgatcatcaggtcgaggtccgaccagcccgtcccggccggcagcacctccaggttcgtcaggcgccccgccgaggagcgtacgtagttgaagtacacctccaccagcggcgcgttcggccggtacagcccctgcttcgccagcgtcggcaggacgtccgagaacatggcacccttcgcgaggaccttctcgaggcggccgtcggtgcggcgcagcacctgctcgaccggctcgcctgcccccgcctcggcagggaacggcaccggcacgccgaagaagcccaccgcgtcgtacgcgtcggcgtggatgcgcgtgtccacgggcacggccagcacgaagcgctcacgctcgcgcctgtgtgccagcagcacggtgagtgtgccgaggcagaaggcggcgggcgtgacggctagcccgctcgcggctgccgacacccgctccatgagcccgtcggggatcgccacggtcacactgccggcccggtacgaccgcgcggccgggcgctccctggtgagtgtcaggtcgagacggccactgccgtggaaggcctcgcgccactcgaccgcggcggcagcacctggcccgtcgccggtcggcacggtcccctcggtgcgctgggcctggatcagcaggtctatgtcgcggttggtgacggtgtcgccgagcgaggtgccggacagttcggcgtcgatctcccccgccacgagcagcagcgactgaagatcgctcaccgcgtggtgcgcgccgaacaccaggatctgtccccgcgcaccaccgtcgagcagttcgaaccgccacagcgccgcggtcgtcaggtcgaacggtgactcgagcagttcccgcagccggtcgccggcgtcgagttccacgtcggcggccacgtccgtccagcgcagcaccgggttcgccggctcccggtccacccgcagctgccgcccgccttcggcaccgggcacgatcgcggtccgcagggccgcgtgccgtgcgacgagccgggtgaggatgccggtgagcgtctcgcgggtggtcggcgtggtgagccgcaccgccaggccgacggcgtgcgccgcgcccggcatgcccggctgggcgctgcgcagcagtcgtacgacatcgcgggtcgcgggccgcagttcggtctccggcacttccagcacttccgaggtgacgtcggccggctgctccggtgtcacggtgtcccgctcgggcagggccgcgaccagggcccgtacgaggccgcggatgtcggacgccgagaacatcgcggcggccgggagttcgacgcccagctcgcgggcgaaggcgttgcgcagccggacgagcatgagggagtccaggcccagttccttgaggaccgtggtcccggacacgtccacggcacctccgcagacctcgccgaccctggcccgtacgtacgcttcgagccgtacggcacggtcgtggtccgtcgtcgccgcgaacaccttcttgacgaggtcgtccgagtccgccccacccgtcgggacggtgaccaggtcacccaggagcgggcgggtccgcgccgcgtccgcgtcgagcgccagcatctcccagtccagggcgatgggcgcgagctggcgccgggacgtggccagcacccgctcgaacagttccccgccctcgtcgggggagaaggcgaccagacccgaccggctggtctcgtcggcccgggtgccggactcggcgaccatgccgacgccggcccaggcaccccagtcgaggctcagcgcccggcggtcggtacgggaaaggtggtgcgcccaggcgtcgaggaaggcgttcgccgccgagtacgggctctgcccggccgagcccagaagaccggccgccgaggcgaacaggaccaggttcccggcttccgggatcagctcggtgagcagggtggtgcccagaaccttgggggcgagcacgcgcaggacgcgttcgtccgtgaggttcgcgaccgtggcgtcgtcgagcacaccggccgcgtggacgactccggcgaccggtccggcgtcacgccgcagggccgccagcgcggccgtcagaccggcacggtcggcgacgtcggcgcgggcgaggtgcacggtgacgccgcgctcttcgaggcccttgatccagcccgcggcgtccgcgccgggcctgcctcggctcagcagggccagtctgcgggcaccacggcggaccagccgctcggcgaccacgcgaccgaggccgcccagaccgccggtgatcaggtacacgccgtccggggtgagctcaccgtgaccgccgtcgtccgggcgcgtacgagccaggcgcggcaccagacgtcccgtgtcccgcagtgcgaccagccgttcgtcgtccgcgtgccggagctgctcccacagggcgtcgacgccgtccgtggacggcaggtcgatcagcgtggtcgccagctccgggtactcctgcgccaccgcgagaccgaagccccaggcgagcgcctgctgagggtgcgtcacctgtgtgctgtcgcccacggcctggctgccccgtacgaccacgaagagacgaggggcccggccctcgggacggtcggcgagcgtccgcaccaggtgcagggtgctcaggcagcacagccgggccgcttgctccgccgtacgggcctccccgatcgccggagcgtcgagcgcggacaactggaccacccgctcgggcagcccgtccgcgaaggcctcgtcgagcaggtgcgccagttgctgcggatcggccggatcgaggacgtaccggccgggtccttcgacgccgaacgcctcgcccctgcggacgatgacatgcggtaccgacgagcccagccgctcggcgagctcgacggccacgcccgtctcgtccgccaggatcagccaactgcccgtggcgggcggctcctgcgcgggcgggcgcggctgccagcgggtctcgaagagcgcgccgtccagtggggagagcgcggccagctcgaactcctccgcttccaggacgagttgctcgttctcgtcccagagccgcaggtccagggtcgcggtgtcgccggccatggaccgcagctcgcaggtcacccacacgggcgtggtgcgcagcccggtgaaccgcagccgtccgaacccggcgggcacgaacgcccggccctcgggcgcgtcgcccggcagcgcggccgtatggaaggcggcgtcgaggaccgcggggtgcagcagatgaccggctgcggggtgcgcggccagccggccgagcgccgcggagtgtgtgcggcggccctcctccaggccccggaaggcggggccgtagtcgatgccgagggcggcgagccgggcgtagacacccggcaggtcgacctgttcggtgcactgctcacgcaggacggcgagccgcgcatcggccatgggttccccggcggtgaccgtgacgcgtccgctgacgtgccgctcccagcgggtacgccgctcaccggtgaccgcggaggcgatggtgaagtcccggacgccgtcctcggcgggccgcaggaccagttgcagccgcacgggccgaccctcgtccagacgcagcggccgcaggaacctgacgtcggccagccgcacctcgccgccgtcctgcagcgcggaagcggcttccagtgccatgtcgaggaaggcggcgccgggcagccagacgtcgccggtgacccggtggtcggtcaggtaggcgaagcggctgtcgcgcaggtccaggtcgctctggaagaggtgccggtcgggctcgtcgctggcctcgacgtgggtgccgaggagcggccccccgccgcccgccggggaggccggggcgggcgcgagccagtggcgttcgcgggcgaaggcgtacgtgggcaggtcgacccggcgccccgtcgggaacagcaccggccagtcgggcgtgtgcccggccgcgtacaactcccccagcctgcgcagcagaatgtcgcgcccgtcctgctgccggcgcagcgagccgacgccgaccgcgtcgatgcctgcctcggccgccaccgcctcgatcgaggggccgagcgacgggtgcgggctcagctcgacgaagtagcggtagccgtcgtccagcatccgccggaccgtgtccgcgaaacggacgggctccctgaggttcgcgtaccagtacgcggcgtcgagccggtccccgggcacgggctcggccagcaccgtcgagtacagcggggtcggcgtccgcgcgccccgcacatcggcgaaccggtcgagcagttcctcgcggagcggatccatcaaaggggtgtgcgaggcgaacggcgtcgacagtcgccgggcggggatcttccgctcctcgagtcggtggagcacctcggccagtgcctcggcgtcgcccgagacggcggtggcgtgcgcgctgttgaccgccgcgacgaacagccgtcccgcgtacggcgcgagcagctcctccacctgcgcgcgcggcagttccacgctcagcatcccgcccttgcccgccagcggtacgacggcctgggcacgcctggtcaccacggtcacggcagcgtccagggtgagggcgcccgcgctgtacgcggcggcgatctcgcccaggctgtgcccgatcacggcgtccggggtgatgccgagcgcacgccaggcggcggccagcgccgcgttgaccgcgaacagcaccggctgaaggaactcggtccggtcgagcggggcgatttcctccggtgcccgcagcacgttgagcaccgaccagccgacgtgccgccgaaccgcctcgtcgatgcgggccagctcctcgcggaaggcatccgagccggccatcaactccacgcccatgcccggccactggcccccgtgcccggcgaagacgaaggccactttgcccgtctgctcctcgcggggcggcacgagcggtgtccgtccggtcgccagcgcgtcgagcgcggcgcgcagttcgtcccggtcggccgccacgatcgccgtgcgccgctcgaagtggctgcggtgccgcgccagggtgtgggcgacgtcgggcagggcgacgtcctcggtcaggtactgggccagtcgcgcggcctggccccgcacgccggcctcactgcgcccggacagtgcgaacagccgcttcccgggcatgggttcggcgttcggctccgtcgcggccggtggtggtgcctcctccacgatcacatgcgcgttggtgccgctgatcccgaaggcgctcacgccggcccgccgcacccgctcccccgacgacggccagtccaccgcctcctggagcaggtgcaggccgctgccgtcccagtcgacgtgctgactgggcgtgcccgcgtgcagggtgcgcggcagggtcccgtgccgcagcgactgcaccaccttgatcagcccgagcacgcccgaggccgcctgcgcatgcccgatgttggacttgagcgacccgaggtacagcggacggttctcgggacgcgagtcgccgaagacctccgacagcgcgttcgcctcgatcgggtcgcccagtgtggttcccgtgccgtgcgcctcgacgtagtcgatgtcggcggcgcccagtgcggacagctccagcgcccgccggatcacctgttcctgagccgggccgttcggcgcggacagcccctggctgcggccgtcctggttgacggccgtgccacgcagcaccgccagcacctggtcgccgtcccgccgcgcgtcgctcagccgcttcagtacgagcatgcccgcgccctcggcccagacggcgccgtcggcgtcgtcggagaacgagcggcagcggccggtcggggacaggccccgaaggcggctgaactccacgaaggtcccgggcgtcaccatcaacgtcacaccaccggcgagcgccaggtcgcactcgcccgaccgcagtgcctgcgccgccaggtgcgtcgcgaccagcgacgacgagcacgccgtgtccaccgtcaacgcgggaccgtgcagccccagcgcgtacgagagccggcccgaggccacgctcagcgccgaccccgtaccgacgtacccgtccagctggtcgagccgggagcccgcgagatagtcgctgccgaacatgccgacgtacacaccggtggtgctgcccgccagttcggcgggcacggtaccggcgcgctccagtgcctcccacgccatctccagcagcagccgctgctgcgggtccatggccgccgcttccttcggggtgatcccgaagaagcccgcgtcgaaggactcgatgccgtccaggaaaccgccttcccgggcgtacgacttgccgagggcctccgggtcggggtcgtacagcgactccacgtcccagcggcccgccgggaacgggccgaccgcgtcacggccctgggcgaccaggtgccacagaccctccgggtcgctcaccccgccgggcaggcggcaggccatgctcaccacggccaccggctcgtcggacgcgggcgtcgccgtgcgggccggctgggcgccgggtgcggtccggcgggccggccggccggccgtcgcgagcgctgtggtcagcaggtactcggcgagccgggacggcgtggggtggtcgaacagcagggtggcggggagcttggcgccgatgcgggtgccgatgcggttgcgcagttcgaccgccgtgaccgagtccatgccgagttcgcgcagcggctggtcggggcggaccgactgggccgagcgcaggcccagggcgcgggaggcctcctcgcggaccagggccaggacgcgttcggcgcgttcggcctccggcagccgggccaggcggtccgccaggccgtcggcgccgtcctggccggtgcggggcgcggggagcagcgagcgccacaaggccgccgccgtgtcgtcgccggccgccgtcgtctcgcgcaggcggggcaggtccagggaccaggcgaccaggtgcggtgcgccccggcgcagggagagttcgacgagttcgcggccctggtcgggggtgagggcgcggtggccgaggcgggccatccgttccaggtcggcgtgttcggcggccagtccctcgcccgcccaggcgccgaaggagaccgagacgccgggcaggcccagcgcccggcgatggtgggccagttggtcgaggaagacattggccgccgcgtagttgctctgccccgcggtgccgaggacgccggcggcggaggagaccagcaggaacaggtcgagcggtacgtcggcggtgagccggtgcagatgggcggcgccgtcgaccttggggcgcaggacccgcgtgaggcgttcgggcgtcagctcggcgaccaccccgtcggccaggacgcccgcgcagtgcacgacgccgcgcagcggcaactcgtcgccgatgcggccgagtacgtcggccagggccgcggcgtccgcgacgtcgcacgccgccacctcgacctcggcgccgagcgcggccagttccgctcgcacctcggcggcgcgcgggtcgtcggcgccctgacgggaggtcagcagcagccgggggacgccgtgttcggcgaggagccgggcgatgtgccggccgaccgcgcccaggccgccggtgatcagcaccgtgccgtcggtgggcgccagggtggggcggccgaccaggtcgaggacgacggggccgcctctccgtatcgcctcgcgcgcggcggtgacgggccacgcccgcgggcgcgtgggacgcgtgtgcccggcggcgaccgacgcgacggcctcgcgcagagccgcaccgagctctgcgcggcctggtgcgacggcatcggcgtgttccccgggcagcgtgaccgcggtggtgaacggcaggccgtccgggagcgccacgaccagccgcgcgtcggcgaccgccgcggagccgggcgcggtgtcggcgacggcgacgacccgcaggccgagggcgagtccctcgacgtcggcgccgacctcggtgagcacaccggccgacacggcgtccggcgcgtcgtcaccggaggggtgtacgcgtgccgcgtgcacctggatccggacctggccgggggccagggcccggggcgccaccgcgcgcagggtcacgtccgccgggaggccggccagctcgtagtggtcatcggccgggatcggcaacgcctgtgcggcgcgggcccgcaccagccgcgggacgagcaacgtgcctgcccggagcgcgagttcgggttcaccggcgtacgcgacggcgaccggcagggcacccccgggatcggagccgtcgaggtcgagcagggtcagcccgaggccggggtgttcggtgcgggcgctgcgggcgaggccccacagcaccgactgggcgaggccgggcaccgtgtccccctcgccggccgcgaccgcgccatgggtcacccaaaccgtccgggtgggcgcctcgtcctcggggagggcgagcagcgcctggagttcggccagtgccgtggccgccaactcctgtgccgcggcggccggttcgacgtcggacgccgggcgcggccagaaccgtacgcggacgtccgcgcccgtctcgcccaccgtgatccccgccgccgcgaggccgcgcagggccgccgcggcctccgggtccgaggggtcgccgaggacggtccactcggtgcccggcgccccggcgggctcctcgggtacggccgtccacgccacctcgtacaggtgccgcccgttctcggagccggtgcccaggtccgccgggttcgcggcccgcagccgtacgccctccaggcggcccgccgggattccgtcggcgtcccacagcgtcacgtcgagcgtgaggtccgtcccggaaccgcccgaccgccttacgcgcgcggtcagttcggtcgctccgccgtgcggcaggacgcagcggcccaccgcgaccggcagcagcacccggccgtcggacgcgtcgcccgcgtcgaacacggcggccacgtgcagtgcggcgtccagcaccgccgggtggagcgggtaggggtcggcgacatcgcgggccacggtcggcagcgagagcctggccagcagctcgccgtcgccggtcgtcaccgccgcccgtacgccctggaaggccgggccgtagccgaggccgaggcgggccagccgctcgtacgtcttggggctccaggccgtcccggccgcctccggccacaccggcaagggcccttgcgtcaccggagcggcctcggccgccgacgcggtggcgtgcagggtccagcccgtgccctcctggccgcgcggacggctgtgcacggtgatctccggtacgggaccggcggtgaccacctcgacggacacctcgaccgtgccggacccgggcagggtgaggggcgtcaggaggaacaggtcggtgacgtcccccggggcgtccgggcgggccacggcgagcgcggcgcggcacagttccatcagcgtcgtgcccgacaccacggtccggccgaacacggcgtggtcgggcagccagtcggcggtggccggggaccactcgttgcggaaggtccagcgggtctcgtccgccgactgcaactggatgccgagcaacggatgcgcggcacggtcgaagagaccgggggcgccggcggccgcttccggttcgatccagtggcgctgcgggtcccaggcgtacgtcggcagatccgcgcggggtgcgtcggcgaccagacggcgccagtcgatccgccgtccgtggacgtggagttcggcggcggcccggtccaggcaggcgggcccgtcctcgtcgcgacggagcgatccgacggcgaccaggtcgggggctgtgtcttcagcggcctcggcggcatcggcgtcttcgacgacggtgcgcagggcggtgagcagggacggatgggggctgagttccacgaagtaccggtagccgtcggccgccatgcgttccacggtgggcgcgaagcggacgggttcccggaggttggtgtaccagtagtcggcttccagttcctcggtgaccggttcgcccaggaccgtggagtaccaggcgacggacgtcgggcaggtggtgatcccgtcgagttcgtcgaggacggccgcgcggacctgctcgacctgggcgctgtgggaggcgtagtcgacgtcgaggcggcggacgaacacctgctgccggtcgaggtcggcgagcagggcttccagtggctccacgtcgccggcgatcaccgtggaccggccgctgttcacggctgcgacggacacccggccgtcgaggccggcgaggtgggcctcgacctcggtgtgcggcagggcgacgacggccatggctccggtgccggacagctcggtcagggcctggctgcgcagggcgaccaccgccgccgcgtcgttgaggctgagcgccccggcgacgcaggccgcggcgacctcgccctggctgtgcccgatcacggcgtccggccgtacgccacgggcccgccacacggcggccagggacatcatcacggcgaagaggaccggctggacgacgtccacccggtccggcgacggggcgcccgcgtcgccgcgcaggacggccgccaccgaccaggtggtgaacgggcgcagggcggcgtcgcagcggtcgagttcgtccgcgaacaccggggagcggtccagcagatcgcgggccatgccggtccactgggcgccttggccggggaagacgaaggccagcttccccggggggagggcttgttgggggccggcgaccctgtcggtgtccggctgtccctcggccagcccgcgcagtgcggtcagcagttcgtcgcggtcgcccgcctggacgacggcccggtgctcgaagtgcgtgcggtggtgggccagcgtggcggccgcctcgggcagcggcgtctgcggatccgcgctgagcgcttcgaggagacggccggcctggccccggagggcggggagggtgcgggcggagagcgggaagagggtctttccggtcaggtggggggctggcaggtggggagcgggcaggtggggagcggtctcttcggccgtcggctgctcgggactctgcggctcgcccgtgggccgcgtcaggtcgtgcggtgcctcctccagaaccacgtgcgcgttcgtaccgctgatcccgaacgcgctcactccggcccgccgcacccggtcgacgtcgcgcggccaccccgccgcggtgctgtgcacgcgcaggccgccgcccgcccagtcgatgtgttcggtcggggtctcggcgtgcagcgatgccgggagcagttggtggccgagggccagcaccgtcttgatgacgccgccgatgcccgccgcggcctgtgtgtgaccgaggttggacttcagggagccgacgccgagcggccggtcggcggggcggcccggcccgaagacggcggtcagcgcccggccctcgatggggtcgccgagcggcgtgcccgtaccgtgcgcctcgacgtagtccaggtcgtctggccggagcccggcggcgtccagggcggcgcgcagcacccgctcctgcgccgggccgctcggggcgctgaggccctggctgcggccgtcctggttgatcgccgaccccttgacgaccgcgaggacccggtcgccgtcccggcgcgcgtccgcgagccgcttgagcaggaccagaccgcagccctcggcccacaccacgccgtccgcctcggtggagaacgggctgcaccgcccggacggcgacagcccgcgcagcctgctgaactcgacgtgcccgcgcggggtcaccagcagggtggcgccgcccgtcagcgcgaggtcgcactcgccgtccgccagcgcccgcgccgccaggtgcagggcgacgagggaggaggagcaggcggtgtcgacggtcaccgccgggccctggaggccgagggtgtaggagatgcggccggaggccacgctggacgcggagccggtgccgacgtgcccgtcgagccgacccagtgaggccgaggcctggtatccgctgtcgtacagaccgatgtagacgcccgtggagctgccgttcagcgtctccgggacgatcccggcacgttcgatcgtctcccaggcggtcccgaggagcagccgctgctgcgggtccatggccgcggcctcgcgcggtgagattccgaagaaggacgcgtcgaaacggtcgatgtcggagaggaagccgccccgcagggtgtacgccttgccggtggcctccgggtcggggtcgtagagcccctgggtgtcccaacggcccgcgggcacctccgagatggcgtcctcgcccgcggtcagcagccgccacagcgcctcggggtcgtcggcgccgccggggaagcggcaggccatggagacgatggcgatgtcgtcgtccgcccgtgcgggcggcgcgtccgcaggcgccgggtccgccgccgtcgcgccgacgggactttcgtcgaagaccgcctcggcgatccccgcgatggtggggtggtcgaagacgagggacgggttcaggggccggtcgatccgctgggagagttccgcggccagagtgaccaactggcgggagctgaggccgaattcggctatcggccggtccaggtcgatgaccggcgcctggagcccggccgcgtcggcgacggccgccgacagccaggcccgcactccttcggaggtcgcgtgggacgtctcggggaactgcttcgggaactcgttcgcaggcatctgggcaggtgtcctcgtgaactcgggctcaggcggtttccgtacggccgacacggctgacggtgccgacgccgatccagcgggcgcgggccgacgccggtccggctgaagcggtcgtcgtacgacggattcaggcgccgtacgaccgtgggcgaccggcgtgcgaccggcacgccggtacgacggcggcaactggcgtaccgccgccggcgctctcgtccgcgccggcggcgggcgacgtcatctcgtggcggccgcgccgaccacggagagggtgccgtcgaggtacgccgtcctggaggcgcggcgctggatcttcccgctggacgtcttggggatggtgccgggatggaccagcacgacatcacgcaccgacagtccgtgggcctcgccgatcgcgctgcggatccggtcggtgatcttctcgaactcgtccgccgcctccggggccgcctcggcgacgatgacgggctgttcgccctccactccgccgtccacggagaacgtggcggtgcagccgggccgcagcgccgggtgggacatctccgccgacagctccaggtcctgcgggtagtggttgcgtccgtcgatgacgatcaggtccttgaggcggccggtgacgaacagttcgccgtcacgcaggaagccgaggtcgccggtccgcaggaagcggccctcacggttcttcagggtggcgcggaagctctcgcgggtggcgagggtgttgcgccagtagcccttggcgacgctcgcgcccaggacccagatctcgccgacctcgccgtcgggcagttcctgctgccgctccgggtcggcgatcaccagggtcacaccggggccgggccggccggagccgaccgccgccgcgtccgccgcgccggcgtgcggtccggtctcgggggcctcgatcagagtgggcggggccgccaccgagccgccggtgaccatcagggtggcttcggccagcccgtagcacgggtagagcgcctcgcgacggaacccggccgtgccgaacgtctcggtgaaccgccgcagggtggcggcccgcaccggttcggcgccgttgaaggcgaccttccaccggctcaggtcgaggccgtcgaggaggtcgggagtggcctgcttcaggcacagctcgtacgcgaagttggggccgccgctggtgtgcgggcggtagtggctgagggcggtcagccagcgctgcggctgctggaggaagtgcagcggcgagaagagtgtggcggtcgcgccgaggtagaccgtgttcagcaccgggccgatgaggcccatgtcgtggtacacgggcagccagctgacgaacagttcgtggtcgtactccgcgatggtgtcgggagtgtggcccatccgttccgtgatgacccgttcgttgtccagcaggttcccgtgggtcaccatcacgccgcgcggagcggaggtcgaccctgaggtgtactggaggaaggcgaccgagtcggcggtgaggtcgggttcgcgccaggagccggccgccgcgtccgggatgtcctcggtggcgacgcaggtgatctcggccagttcgggcaggtgctccgccatggtgcccagggcggcgatcacctcacggccgcccaggatcaccttggcgtccgcgtcggcgatcaggcgcttcatccgggtcagggcgcggtggttctgcgaccggccctgcgggggcacgcccggcacggcgacgaccccggccgaaaggcagcccaggtagccgcagatgaactcgagaccgggcggatacagcagcatggcgcgggagccggccaggccgcgctcctgaagccaggaggcgacggcgcgggaccgttcggccagccgcccgtacgagatgtcctggatctctccgtcacggtcgcccgtgacgagatagcggtaggcggtccggtcgggctggtgcgaggcgtgcttggtcagtaagtcgaccagggatcgagccatatgaagagtctcacctgtctggatcagtgggcgagggaactggagttcgagggccgcgtgacacacacgcgcagaagccttggccgacctggcccccttgccagaccgtccgtctcaaccacccgcccgaggagctgcggcgatacgtccgccgacccctcgcgccccccattcagcttgctaccaacgggtaacaccctagcaagtcccacccgcccgagggacagaccgcatgtaaacgctgcgcgtcgaggatgcgcccacgaccgcaattcacccgattgtgggataatacaatatgacccatgaaaggttactttcgtgatcaacagtggcaatgggactgattacgagagcatgcggttcgaccgcagaggtcaggccgaggccttcgacgccatcggcgaccgctacgacgaggccttcccgcacaaggagggccaggtttccgtcggcgaatggctgatcggatccctgccgccgcgatcccgcgtgctggatctgggctgcggcaccggaatgccgaccgcgcgccagctgacggacgccggcttcgacgtggtgggcgtcgacctgtccggcgggatggtggaactcgcccgcgcgtatgtcccgggtgcgacgttccaccagttggacgtcgccgacctgcgaccgggcggctctcgcgacctgggccgcttcgacgccgtcgcggccttcttctccctgctgatgctcccgcgccccgagattccgctcgcgctgctgacggtccgccatctcctcgttcccggcggcctgttcgccctcgcgatggtggaagccgatgtggacgacttctccatcccgttcgtcggacacaccatccgggtctccggctacctgcgggaggacctgcacacggtcatcgagaccgcgggcttcgagatcgtcaaggagttctcctacacctatgccccctcggtcgccgacgtccctcccgaggaacaggtcttcctctgctgcagacggcgcggctgagaacgcacgagccatcaccgcggaccgcggcacccacggaacgggacaaacgcgtgacggagcaccacacccctcatgaaggcccggcccaggcctcccggcagtccggcggcccgctgagcggggccgggcctgtcgcacccgtcacgcccatgggcccgcgggtcacccggacgccccagccgccccccgcgcacggccgccacgacgggggcaggcccgggcagccgggaaaggggccggtcaccccgtcccgtgccgacaccgggcgacacgcgccggaaggggacgctcccgaagcggagtacgccgagggagcggtgccggacagcaccgggccgcagaccgaccgactcaggtatctcgacgtggcgacccggcagatcgcccgcgggatggacctggacgagacgctccgagaactgcaccgggcagccgttcccgcgttcgcggacgtgatattcatccatctgcacgatccgctgccggtcggcgacgagaagtcggccgcgcccgtggccctgcaactgcacagcatcgaccggacgccggagcccgcccacaccggctggtctcgtatgcccgctccgacgagtcttcccctgccctcggatgtggccgagcgcgtccatctcaccgccaccggccggctcgcgacgctcctgctggccgggcggccggcgttcggcgacgcgccggggatcgcgcccgcggtggccgagttgctcgggcccgtggcgagcgtgcccggggctctgccgccgggccgcagactggtcatcgctcccctgcacggccgccaccacgtcatgggcaccgtcgttctcctgcgccggcccgaccggcccgccttcaccggtgacgacctgctggtcgcctcccagctcgcgacccacaccgctctcggcgtccagaaggcggtgatgtacggacacgaggcgtcggtggcggacacccttcagcacaccatgctcccgtcgtcgctgcccgaacccaccggcgtccggctggccagccgatacctgcccgcctcgaagaccgctcaggtcggcggcgactggtacgacgcgatcccgctgcccggcagccgcgtcgcgctgatcgtcggcgacgtcatgggccactccatgacctccgccgcgatcatgggccagctgcgcaccagcgtgcagaccctcgccgggctggacctgcctccggacgaggtcctgcaccatctcgacgagcaggcccagcgcctgggcagcgaccacatcgcgacctgcctctacgccatctacgacccgatatcgcaccggctgctcatggcgagcgccggccacccgcccgcggtgctcctgcaccccgacggccgcggggaagtactccgcatcccgccgggcgccccgatcggcgtcggcggcgtcgccttcgaatccgtggagatgcccgcgcccaccggggcgacccttctgctgtacaccgacggcctggtcgagtcccgcgagacggacgtgggaacgggcgtcgaggcgctgcgtgcccgtctccaggccactgccgacgggcgcgccgccccctcgctggaacggctgtgcgaccaagtgctgggcacgttggggccgggcacccgggacgacgacatcgcgctgctcgccgcccggttcgagggcttccctccggacagcgtggggtactggttcctggccccccacccgctgaccgcgcggcaggcacgccggctgacccgcaggacgctgcggcgctgggggctggagtccctgctcgattcgacggaactcatggtcagcgaggtcgtgacgaacgccgtgcggttcgcctcacggcccatcgcgctgcggctgctccgcaccgacgtgctccgctgcgaggtgaccgacgactcccctcaggtgccccggatgcggcatgccgagccaggtgacgagggcggccgcggcctgtttctggtcaatcaactcgcgcggcgctggggagcgacgcggctgagcacgggcaaggtggtctggttcgagcagctgatcccgaagaagtagccggcccgcgccctaccggccggttgcgcagtccgccgtgctcgggacaggagtgtcccggagttcggtgctccggggcgcggagggccgctggatgacgagggcgagcagggcggcggccgcgcaggcggcgcccaggagtacccagacgaagtcgtaactgccgaacgcgtcgcgggcgacgccgccgagaagggcggccagggcggcgccgacctgatgggccgcgttggtccagccgaagacgatcgcgctgtccgcaccgtggaactggcggcacagggcgatgacgggcgggaccgtggcgaggtccaggaggccgaagacgacgacgaagaccatcatgggcgggttgacggtcgcggccatcagcagcggcagagtgacgagcaggacgccgcggagggtgaagaagacggcgagcagacggcgggcgtccacgcggtcggtcagccagcccgagccgatggtgccggcgacgttgaagacaccgatgacggccagcagcgtggaggcggtggtcaccggcatgccgtgatcgtgggcggccggggcgaagtgggtccacatgatgccgttggtggaggcgccgcagatcgcgaacagagcggcgagcagccagaacggacgggtccgcgccgagtcacgcagcacggtgaccgtgcgacgggcggcaccggtcaccggaggcggcttggggacgaaggcgtcgctgccgtaggggcgttggccgaggtcggccggatggtcccgcagcgtgagccggacgaggggagcggtggccagggccaccagggcgagagtgatgagggcggggcgccagtcgtagtggtcgatggtccaggacagcgccggcaggaagaccaactggcccagcacgctgcccgaggagagcattccggtcaccaggccgcgccgctgtacgaaccagcggttggtgaccgtggcgccgaaggtcatcgccagggaaccggtgcccagaccgacgaggaagccccagaagagggtgaactgccaggaggcgttcatcaccgtggtgagcagggcgccgccggcgacggcactgagggcggcgacgaccacccggcggatgccgaagcggtccatcagggccgccgcgaagggggcggtgacgccgtagaggaccatgttcacggaggcggcgaggccgatggagcccctggaccagtggaactcccggtgcagggggccttggaggatgccgggcatcgtggaaaaggcaccggcgaccacgatggccagtccggcgacggcggctacccaccaggcgcggtgtccctgagcattgcgggggtgtccggttgtgtcttccatacccgtcacccttcgtgaggcgggacgcccgtaccactggccgactggacaggtagtgaaacaatccggccatgcgtgaggagaaggcacaccgcgtggtgatcctggtgcgccccgggctgcttccgatggaactgggcatcgtgcaccgcctgttcggcacagcgcgcggagcggacggccggcgcctgtatgcggtggtgacctgcgctcccgtgcccggcgagatcaccaccgacaccgacttcacgatcaacgtgccctgcgggcccgaagcgctggagggtgccgacacagtgatcgttcctgcggccgtggaggactacaccccgcagaaacgggggcagttggccgccccggtgcgtgccgctctggcccggatccccgacggtgcgcggctggcttcgatctgcaccggatcgttcgtcctcgccgccgccgggctgctggcgggccgccgggcgacgacgcactggaagtcctgcgaggaactgcgcacgctgtacccggagatcgacgtcgaccccgacgtgctgtacaccgacgaccggggtgtgctgacgtccgcgggtgtcgccgccgggatcgatctgtgtctgcacatgatccgcagtgatcacggcgcggaagtggcgaacaccgtggcccgcgacaccgtcgtaccgccccatcgcgagggcggacaggcccagtacatcgaacagcccatccgtgaacccgcggatgcctccacagccgccgcccgcacctacgcgctgcggcatctggaacagccgctcgtcctggaggatctcgcgcgggaggcgtcgatgagcgtgcggaccctgagccgcaagttccgccaggagaccgggatgacgcccatccagtggctggcccaccagcgcctccagcacgcccgtcggctcctggagcagaccgatgaaccggtggaccgcgtcgcggcccgggccggattcggcaccggcaccgcgatgcgccagcgcttcagagaaacgctcggcgtgtcaccgcgcgcgtaccgccataccttccgagggacggcgcggcggcatgcgcccggctgatcgtggccgtccggcggccgcgggtggctcacgggaccgacctgacggctcgggctgtcccacgggaggccggcgccacgatcgaacgtgtcgtaacgcgcggacgttgccggacatgcgggatcatggggatatccatcgccccggacgccgagtttccccagcaagtggccggaccggaaggagcggcatgagacagagcggatcggtcaccttgggcgcggcgctgtgcacagccgcggcacttggcctggcagtgccacctgtcgccgtagccgtccccgatcgctgttcctacgtgtcgtcgacggcgcggccgatgctcaccctcggtgacaccggtaaggcggtcaggcaggcgcagtgcctgagcaacgtgtggggaggccagccgcccaagctggccctcgacggggtcttcgactccgtcatgctgaagaagatcgagtggatccagggctgccacggcctgccgccgagcggtgtcatcgagggccgcacttggcaggtgctttatgacccggccctggactgttaccacccctatccgtcctgagcttcccctcaccagcccgttggcttctcccggagccactccatatccaccccgaaccaaccctctgaccggcggagtgcgcgacgaccggccgtcgtaccggccggccgtcgtcccagccggccgacgtgccgcctcggcggcctacgcgccgagatggacgcttggcgagagccacgtcggacggggccaggccgaagtgctcctcgagcatcagctcggcctgggtgagcgcgccgtagacccatccctgccccgtcgaccacgccgatccgcagacatacaggttggcgtcggggagcgggtggcgcatccgtggcacgacctcccagctcttcgcccccacctgccagaagtggcaggccgctccgtacgggtcctgcacccagtcctggaacaggcccaccgcgagggggccgccgcgccgccgccgaagctccttcagcttgcggctgcgctcggcttccgggccgagcagccgccaggcagcgtacgccccggacaccccggtgtggacgcgcgctcggttccgcagggagccgataggcggggagcccgccaaccgggcgggctccccgcgggtccggcacgatgccaggccgatgacgcgctatgcctgaacactggtggtctcagatgcaggcgggagagagcacggacaacctcggcactcgagaagccgggaaagccacgtctgggggcacaggcacccatggcgcgtccgctcagccgggattcgtcggcgccgctctcgccgccgtgctcacattcgcgctcgcgcagggtttcgccatgacgccgttgccgactgcctggcgtccacgacaaccctgtggctgaccgtgtacggagccggggcggccctgctggtgggtctgggcgcgtggttcttcgaccgcactcgtccacggagagaaacggccgtgggcacccgaagcgcttagccccgggctttcgcgcgtccagcaggcttgagaccccgacacgtaggtgcacccgagtgaccaggggaggcgcagggcggcggagggtcggcgccggcggttgcccgcccgagcggaacgagtccatcagccaagaaagctcagccgcacctgacggttgggattgtcctggttcgtgtccaccagacacaccgactgccaggtccccagttgcagcctgccgtcgatgaccggaagggtcgcgtgtggggccacgacggccgggagtacgtggtcacggccgtggccggggctgccgtggcggtgctgccagcggtcgtcagcggggagcagggtgtgcagggcggcgaggaggtcgtcgtcgctgccggcgcccgtttcgatgatcgcgacaccggccgtggcgtgcgggacgaagacgttcaggaggccgtcgcggccggccgccgtgtcgcggaggaaggcctcgcagtcgtgggtcaggtcgacgaccgtctcctgcgagccggaggcgacgttcaggacgcgagtggtgaaggcatcggacatgcctcaatcctcacccatgcgccggggttcgcgcgcgagcgatcgcccgcgccttgatacgaggggtccagtccgcgagacgccattgaccgggcaagggccgtttggctactttcagccgcatgttgcgttcagccatgctcaccacgcgcggtcacatcgacctgctgcgggtggcctccgccgcgtgtcgccgcggccgctgacgccctttcactcctctctccccgcctgcacttcgccctgcccgcacgtctgatgccccatcggacgcggcggcgtccaggcgcaccctcttcaggccgctctcctccccgtggagcactcatgagcatcagccatgccccgcccggctcacccaggaccgatatttcggcaatatccaaggatgagcaggcggtgcccgcgctcgaacccatcgtccccgcctccacccgccgcacccgcgtcccgcgctggctgcgccgcacctccggcccggtcctgctgctccttctgtggcaactcctcagcagcacgggcgtgttgacctccgacgtccttgcctcgcccgggcggatcgcccaggtcgcccgtgatctcgtcgtcgacggctcgctgccgaacgcgatgggcgtctcgcttcagcgggtcgcggtcgggctgctgttcggggccgccatcggcaccgggctcgcgctggtctccggcctgttccgggccggcgaggacctggtggacgcgagtgtccagatgctgcggaccgtgccgttcgtcggcctgatcccgctgttcatcatctggttcggcatcggcgaggcgccgaagatcgcgatcatcacgctcggcgtgtccttcccgctctacctgaacgtctacgccggtatccgtggcgtcgactcccagctcatcgaggccggagagtccctcggcctgtcccgctgggggctcgtgcggcatgtggtgcttccgggtgcgctgcccggcgccatgaccgggctgcgttactcgctcggcatcgcctggctggcgctcgtcttcgccgagcagatcaacgcggacgccgggatcggcttcctcatggtgcaggcacgggacttcctgcggaccgacgtgatcgtggtctgcctgatcgtctacgccttcctcggcctgctggccgatttcgtcgtccgctccctcgaaaggctgctgctgcaatggcgaccgacgttcaccggccgttgagtacacagaaggccgcgaccgcggcggcccaggcgtccacggctgccgcctccgccgtacgggtggacggcctgacccgctccttcgacggccgtgccgtcatcgacaaccttgaactcgacgtccgcccgggcgagttcgtcgctctcctcggtcgcagtggctgcggcaagtccaccctgctgcgcatcctcgccgggctcgaccgcgacatcgagggcacggtgctggtgccgcgccgcaaggccgtcgcgttccaggccccccggctgatgccgtggaagaaggtgtggcgcaacgtcctgctcgggctgcccggaaagcccgagcgtgccgtcgccgagcaggcgctgaccgaggtcggcctcgcccaccgctcccacgcctggcccaagaccctctccggcggcgaggcccagcgcgcctcgctggcacgtgcgctggtccgcgaacccgatctgctgctgctcgacgagccgttcggcgcgctcgacgcgctcactcgcatcaaggcccagcggctcgtcggcgaactctggcaacgccggggctgcgccgtcctgttggtcacgcacgacgtcgaggaggcggtactgctcgccgaccgtgtcctcgtgatggacgacggcgtcatcgcgtacgagacggaggtcgagctggaccgcccgcgcgacatcaccgacccccggttcgcagaactgcgcgccgaactgctggagcggctcggtgtcgacaccgccgcagaggccgcctgaacccgcacgctccccgagccgcacgccccgcgctccccagagccgcacaccccaccccttcagcccgcccccggggcctcaccctcacctgaaccaagcgaacggaatcaccatgcgacgacgcctcgcccccgctctgctcctccccttccccctgctactggccgcctgcggcgggaattcggcggccggcacctcgacgggcggcaggacggacggcaaggggtccctcacgctcaacgtcggggaccagaagggtggttccgaagcggttctgcgggccgccggagagctcaagaacctgaactacaagatcaagtggtcgacgttcacgtccggaccaccgcttctggaggccatcaacgccaaggccgtcgacatcggcggcgtcggcaacaccccgcccgtcttcgcggccggcgccggctcgaagatctcggtggtggccgcctggcacggcacgtccaagggcgaggccgtcctcgtaccgaagaactcgtcgctgcggaagcccgaggaactcaagggcaagtccgtcgccgtggcgcagggttcgtccgcgcactaccagctggtcgcctcgctcgaaaaggccggtctgaagctgagcgacgtgaaggtcaagtacctccagcccgccgacgcgctggccgcgttcaccagcggcaaggtggacgcctgggcggtgtgggacccgtacacctcgcaggtgctccaggcgaagcagggccgggcgctggtcgatggcgacggtgtggtcaacggcctcagcttccaggtggcggcgccctccgcgctcgcggacaagaagaagagcgcggccgtcaaggactacctggagcggctgcggcgcgcccaggactgggtctatgagcaccccgccgcctgggcgaaggtctgggcgaaggacaccgggctgccgtacgaggtggcgctggcctcggtgaagcgcaccaacgccagccgtgtccccgtcgccgtcgacaagccgctcatcgcctccgagcagcagatcgcggacaccttcaccggtctgaagctcatcccgaagaaggtcgacttcgccgacttcgtggacacgcgcttcaacggcggcctgcccgcttccaccagcacgccccgcgtctacaaggactcctgatgaccgtccatctccactggttcctgccgaccggcggcgacggccgcaccctcgtggaccggcacgcctacgcctccaacagtgccgacctcgcacggccggtcaagggcgtacgcccgcccgacatcgagtatctcgcgcagatcgccaaggccgccgagcagttgggcttcgaggcggtactgacgccgaccggcacctggtgcgaggacgcctggctgacgacggtggcgctcgcccagcacaccgagcggctgaagttcctggtcgcgttccggccgggcgtcatctcgccgacgctcgccgcgcagatggcggcgacctaccagcggatcacccggggccggctgctgctcaatgtcgtcaccggtggcgactccaccgagcagcggcgcttcggcgaccatctcgaccacgaccggcggtacgcgcgtacggacgagttcctctcggtcgtccgcggggtgtggagcggacgtccgtacgacttcgacggggcgcactaccaggtcgagggcgggctgaccgcggtaccgcccgacccgctgccggagatcttcttcggtggctcgtcggccgccgcgggtccggtcgcggcccggcacgcggatgtgtatctgacctggggcgaacctcccgagcaggtcaaggagaagatcgaccggatccgttcgctggccgagcgcgaggggcggacggtgcgcttcggcatccggctgcacaccatctcgcgcgacgcgtccgccgaggcctggtcgaccgcgcaccggctcctcgacgacctcgacgcggacacgatcgccgccgcgcagacggcgctcgggcgcagcgagtcggtgggtcagcagcgcatgctggccctgcacggcggctcgcgcgaccggctggaaatctcgccgaacctgtgggcgggcgtgggtctcgtgcgcggtggtgcgggcaccgctctcgtgggcagtcatgccgaggtcgccgaccggatcgaggaatatcacgcgctgggcatcgagcacttcgtgctctccggctatccgcatctggaggaggcgtactggttcggggagggcgtgatccccgacctggcggctcgtgggctgctgccccctgtgacggcagggggtggctcgccgctgctggtcgcgggtggccgctgacgatcgggaagatcccggaccccgaccgagttggtagaagcgtgaacaacatcggggtaccggcgcgcgaagtcgacgtggtcgtcacaggcgctgggcaggcaggtctgtccagcgcctttcacctgcggcgcacgggtttcgaaccggaacgggacttcgtggtcctggaccacgccccgcgtccgggcggcgcctggcagttccggtggccgtcgctgacgtaccgcaaggtgcacgggatgcatgcgctgcccggcatggagctgacggacgccgatccttcgcggccgtcctccgaggtcatcgccgagtacttcgacacctacgagcgcaccttcgacctgcgggtgcgccggccggtcgacgtcacggccgtgcgcgagggtgagggcgggcgcctgctcgtccagacctccgacggcacgtgggcgacccgggcgctcatcaacgccaccggcacctgggaccggccgttctggccgcgctatccgggccaggagtcgttccgggggaggcagttgcacacggcccagtaccccggccccgaggagttcgccgggcagcgggtggtcgtcgtgggcggcggcgcgtccggcacccagcacctgatggagatcgctccctacgcggcctcgaccacctgggtgaccaggcgtccgccggtctttcgcgagggtccgttcagcgaggacgtggggcgggcggccgtggcgatggtggaggagcgggtccggcgggggctgccgccgcggagcgtcgtctcggtcaccgggctgccgctgaacgacgccgtccgacgcgcgatcgcggacggcgtcctggaccggctgccggtgttcgaccggatcaccccggacggcgtggagtgggacgacggacggcgcgtggccgccgacgtcatcctgtgggcgaccggcttccgcgccgcgatcgaccatctggccccgctgcggctgcgcgcgccgggcggcgggatccgcgtcgagggcacccgtgtggtcgccgatccgcggatccacctggtcggatacggcccgtcggccagcacgatcggcgccaaccgggcgggccgggcggcggtacgggacatcaggcggctgctggcgggagagcccctcaccgtgtgacaccccgcacggcgtctcaccggtgcgacggcgacggcgacggactccggcggttccggttgaactcggcgacgttcttctgatgctcctcgtagctcgacgtgaagcgggtgtcgcccggcttgaccgtgacgaagtacagccagtcccccggcgtcggattgaccgcggcgcgcatcgcgtcctcgccggggttggcgatcggcgtgggcggcaaccccatgcgctggtacgagttgtaggggctgtccagcttcgtgtcggccaccgtggtgttcagcgtggagcggttcatcgcgtagttgatggtggagtccatctggagcggcatcccccgctccagccggttgaagacgacccgggtgaccttgcccatgtcggccttggtcgccgcctcggactgggcgatgctcgcgatggtgacggcctgatacatggtcatcgcgttgcgctgcgcccccgcggtgatcgggctgccgcggaacttcttgttcgcggtgtcgaccatggcccgcagcagggactcaggcgtcgccttctcaagggggtacgtcgccgggaagaggtagccctccgggttgccctccgcgtcgcccggcagcttgaggttcgccttggcgagggacttcctggtagttcccgcgggcagttcgagggccttgtcgacggcctcgtagatctgtccggaacgccagccctcggggatcacgagggaggtgggccgcgtgggcccgtcgctcttcaggatcagcagcggcaccgccacggcggtggccgccacgacggctccggtcgcgatcagggcgccccggccccggcgcgtcagtcgaatcgtgctccgtggcggagtgttcatctgcatgcgggcacggtaacccgctaaacgtcacaaacccggcatatcttcatcttgtcggctccagttgggcgtctcggcgcaccagggccgcgtaacggccgtcccgctccagcagttcctcgtgcgtgccgcgttcgaccgcgcgcccggcgtccaggaccacgatctgatcggcgccccggatggtggacagccggtgggcgatggtgagcgtcgtgcggttggccgagagtgcgtcgatggcttcctggacggcgcgctcggtgcgtgtgtcgagggcgctggtcgcctcgtcgaggatgaggaccggcgggtcgcgcaggatggtgcgggcgatggccaggcgctgcttctcgccgccggagaagcgatggccgcgctcgccgacgaccgtgtcgtacccgtcggacagggaggcgatgtggtcgtggatctgggctgcccgcgccgccgcgtacaactcctcgtcggtggcgtccggcttggcgaagcgcaggttctcggcgaccgaggcatggaagaggtacgtctcctgggagacgacgccgaccgcgcgcgcgagcgtgtcgaagtccaggtcgcgcacgtctacaccgtcgagcgtgacgcggccgcccgtgacgtcgtacagccgcggcaccagatggctgagggtggacttgccggagccggtggggccgacgacggcgaggctgccgcccgcggggacgcggatgtcgatgccctggaggatcgggccgctcttgtcgtcgtagtggaactcgacgccctcgaagcggatctcacccttgacctggtcgaggtggacgggctggtccggctcggtgatgtcgatgggcaggtcgaggtactcgaagatgcgctggaagagcgccagcgaggtctggatctggacgccggtggagagcaggctcacggtcggccggaacaagccctgctggagcgagacgaaggcgacgagcgtgccgatcgacaccgaggggccgccgagttgcagggcgatgcccgcggtccagtagatgacggcgggcatcgcggccatgacgatgctgatgacggccatgcgccagcggcccgccatgttcgacttcacttcgaggtcgacgaggctctcggactcgtccgcgaacgactgggtgagggagtcggcgcggcccatcgtgcggcccagcaggatgccgctgacggagagcgactcggtgaccgtggccgccatcgtggccatctgcttctggcgctgggtggctatcttcttgcgctcgttgccgacgcggcggctgatccacacgaagagcggcagcaggagcagcgacacggcggtgagccgccagtcgagggcggccatcgcgacgatcgtggcgacgacactggtcagattggagaccagggaggtggcggtcgaggtgaccgtcgcctgcatgccgccgatgtcgttggcgatgcgggactggacctctccggtgcgggtccgggtgaagaaggcgagcgacatgcgctggagccggccgtagacggcggtgcgcaggtcgtgcatgacgcgctggccgacggtcgtggagatcagggtctggagcacgccgaagatgctggtgacgaccgagctgacgatcatgcccagcgcgagcaggctcagcagaccggtgcggccctgcgggatcgcgacgtccaggatctccctcaggaggaagggcgtggcgacggagacgagcgaggcggcgccgaccagcagcccgacgatcgcgagccggccgcggtagggccggaagagcttcagaatgcggcgcacctgtcgcggctgttcggtggcggcgggtgacggggtccaggtgggtcggtcgggatgcatgggctcctacggaggcgagacgaggacgactgacggagcttagctcattgttacctatgctcacaatgaacgaggtcctgatattgttcccgacatgaccacccccgatcccgacggcctgctcgccgagcagttgctgcggctcacccgccgtgtgcaccgcatccagaagcgccatctggagcagcgcggcctcggcatcacaccggcccagtcccggctgctgcgcaccctcgcgcactacagctcaccgccccgcatggcggacctcgcccagcgtctcgaggtggtgccgcgggccgtgacgacgctcgtcgacggcctggaggcgagcggcaaggtgcgccgggtgcccgacccgaccaaccgtcgcgtgatccggatcgaggtcaccgacgagggccgcaaggcgctgcacgaactgcgcggcgcgcgccggtcggcggcggaggagatcctggcccccctgaccgacgaccagcgcgaggtgctcggggggctgctggacacgttggtggacggcgcaccggaaggggagcggcactgctgagtcgtcccggacgaggcgtgcgggatgccggccttgccggacgcggcgcgggcggacgcgcggcgtgacatgacgcggcggtgcggggtgacggcggtacgacatggcggcgcggccaccgcccgcacgcgccgtcgggcttgccggtgtcgcctcctgcccctgcctcctgccccgcctcccgggagacgcccgtaccgcgcgcgtgagtggcggccgtgcgcggggcggtcgccacgcacggggcgtggagcaggcggacgggccacgactccccctccgtaccgaaggagtggtagccgcggcccgcccgatcccgtacagccgtcagccgacctcgggtgcgggctccttgaccgaccgggccggcaccgtcggcttcgcggcttcggcttccggagtctcggcgtcggtccgcggagcgtggtcgtcgtcgtccggtacgaacgcgatctcgccgtccagcaccttcttcgcccgcgccgtgtccaacgcgccctcccagcgggacaccgcgaagacggcgacacagttgccgagaagattggtgctcggatacgcgtgcgtcacgtccgtgtaaatcatggagcggccccgacgaccgcctcagcagtcgctgcggtcacgcgtcaacaccccctgcacggtgacgaggttgcggtcgtagcagcccgccgaaccgctcagccggtagcgctcgctcgtcgtggcgaccgcgtggcgctggtcgcgcggcacgttcgccgtatacgtggcatcacccgtgtaggtgtcgtcgagccgggaccacgcggtgcgccggccaccacgcgactcgacggccgtcgcccggtcgccgagcgtcagggcgctccgcagccggtcgtcggggccgagcgtggtggtgccgtccatcgtgtacgtgcgccggatacgcgtcgtccggtccggtccgcgcccgtcggcggtgaccgactcgtcgtcgttccagacggcttggaggccgtccatgttctcgccgtcggtccagcggtgtgcggaggtggtggcgagggtgcggctcacggtggtcgtcacccggccgtgcgaggtgttcacatatccggcgaccgtcagccggtggccgccctcggtgtccaggcgatgttccgaaccgggcgtgtacgtggtggagttggcgaggtctgccgccttgtgggcggtgagtgcgccggtgacccgtgtgctcttcgtgtcctgccagacgaggacgttgaccggtgcgctccagccggcctgcccctcgggaacgccgacgacggagacgtcgacccggtgcggacggccgtcgttgagcagcccggcgaaaggtgtgaggtcgtactcgatcggcttgacgtcgaaggcgcgcggtcccggaatcacgtaccagaggaaggggttcgaccagccgccggtccacacggtcgggaacggtgcggcgattccggccagttggccgtccaccttgatctgcacctcgcggtagggccccttgtccgccttgcaggagtacggcgccgagtccggcaccgtcaggtaccagaactcctcgcagccgccccccgagccggtggcgtacacctcggcgacgatgcgttcgctgttgcggggtgtggtgagggtcgtcccgtcggcgagggtgaggacgcggtcgggggtcgccgccggtccgttcgtgcggtcggccgcgtagaaggtcagcgtggccctgacgtcgatgactccggtgtacgtgtcgtcgacgacgttgccgatgagcatctccacgtcgcggctctgccggaacgtgtcgctgtaccgggtgacgtccttctcgacggaccactcgatgccgtcgggcgaaggctcgggggtggaggtgcggaggatctcgacgccgccgatgtgcaggtagccgaggcggtcgaactgccgcccccgcaccttgccgtcgagccgcagcacgaccctgctccagcggtcgccgcagccacgcggcggcgcatatgtgccccggtacggcgtgaagtcgcggaactgtgcctcggcgacggtgacctggcaggatctggtggcgggtttcccgatcggcggggccgcggtcagcgggtcgtgccagtcggtgccgaattcggcgggtggggcgggctcggcggacggcgtggcctcggcggtgtgcttgcctgccgctggtgcgggactcgccccgaggagggtgctcgccacgagaattaccccgacgagcatggacatgactatccggcttctcatggcccgtgttctacgggggagttgaccccacccgcaatgagtaccgcgacgagctggcggagaacagtcgcggagcgggcggggaccgggcggagagcaggcggggaccgggtggggagcaggcggggaccgggtggggacaccccaggacagtgtcccgcgttccaccggtgggactaggccttgaggtccgccttgtcccccatcaccaccacagggtgctggttcgggtcgagcgtgcgcagcagatactccataccggacttggacaggctcacacaggccgacgtaccgccggcgtggtccatgtgcagccagatgctgccgcccttcgactggccttcggggcgggtcgggtcgttcggcgcggtgcccttgacccggttgtagtcgatggcgatgacgtagtcgaagtcgtgccagtgcgacctggaccagtagtgcggagcctggaaggacgccgactgcgtgtacgggagctccgcgcccggatcggcgaggacaccgcccgcgtcgctgagcgtgaacacaccgacggggctgcgcttgtcaccctcgtggtggtcggtggtccagcccttcttgccgttgtgcccttcccagctgcgggtctggtcccaggtggagccgttcttcgtgtacagcacgatcgtggagtccgccgagtccttgccctcgccgtagaccgccacgacctggcgcgagttggccgggatcttgttctgtagccggtcgccgacgtccgggatgcggagcagatcgacggtgggcgccttggactgccccgaaccggagcccgccttgccgcccgatccgccgccgcccttcgccgcgttcgacccgtccgaaccaccgcaggccgtcagggacatcagaaggacaccgcaggtcgccgccacgacccccgcgcgtaccgcaccgctcgcaccgccaattcgcatgcgaaccatcgtcgcaccacgttccgggcgattgcgcacggccccctgcttcccggccatatgcgggcggtccgggccgaacctttgcctccggaccggaaaatcgcttgcctccgaccacgctgtgacgcgaacctttcacggtttgttgtcgccgacagggccagtccagccttgagctccagcagtccattcatcccatttcggcacttttcacccttcgccgctcctcctccccgttcaccccctgacacgagccactgggacgtcatgcagattcaagaccttccgtatcccgacccaggtgtgccggacgcgcgctcgggtccccgattcctttggtggctcttccggaatcagctgggcggccagctgacgagcctcgcctggggtctgctgcacttcctggccgtttccgggctgccgttctgcgtcggcctcgccgtccaggcggtggtggaccgctcgggcacccgactcgccctgaccggcgggctgatcgtgctgtgcggcgcgggcctcgccctgggcgaatccatgctgcaccgggccgccgtcaccaactggatcaccgccgccgcccgcgtccagcagctgctggcccgcaggaccgcgcagctcggctccgccctgacccggcgggtcgcggccggcgagatcgtcgcggtctccacgggcgacgtcgagaagatcggctggttcgtcgagggcgtctcgcggttcaccgcggcggccgtgaccgtcgtggtggtctgtgtcgggctcgtcgtgtaccagcccgccctcggcgtcgtcgtcgccgtcggcgtaccggtgctggcactcgccgtgctgccgctgctgccccgggcgacccgccgcgccgacgtccagcgcgagaaggcgggccgtgccaccgagttggcctcggacacggtcgcgggcctgcgggtgctgcgcggcatcggcggcgaggagctgttcctcgaccgctatcgccgggcctcgcaggaggtccgcagggcggccgtgcgcagcgcccgaatgtggtcgctgatctcggcgatccaggtgctgctgccggggctgctgatgatcgcggtcatctggcgcggcgtgcatctggccgtcgacggccggatcaccgtcggtgaactcgtcaccgtgtacagcgcggtgatgctgctcacctatccgttgcggcacttcgaggagatcgccatggcgtactccttctcgcgcccgtccgccaggcgcgcggcgcgcgtgctgtcgctggagcgcgccacggacacggcgggatcgcgcgaggcggacgtgccggacggagatctgtacgaccccgcgaccgggctgctcgcgcccgccgagcggctcaccgccgtggtgtgcggcgacccggacgcggcgggcgtgctggccgagcggctgggcggccacccgtccgaagaaggcacctcggtgctgctcggcggcgtgccgctggacgaacttccactcgactccgcccgcaccgccgttctggtccaggacaaggatccggtgctgctgtccggttcgctgcgcgaactcctcgacgtacccgcgtcgggagaggtgagtgccgccgaggcgctggccgcagcccagtgcggcgacgtcctggaggcgctcgcccaggggtcgctggaggccgaggacccgatggacgcgcggatcaccgagcgtggccggtctctgtccggcgggcagcgccagcggctcgcgctggcccggtcgctgatcacggacccggaggtgctcgtcctggacgagccgacgtccgccgtcgactcgcacaccgaggcccggatcgccgacggcatccgcggcctgcgcacgggccgcaccacggtcgtcttcacctcctcaccgctgctcctggaccgcgcggaccgggtcgtactggtgcacgagggcgaggtggtggcggtcggcgcgcaccgcgaactggtgcacagcgagccccgctaccgggccgtcgtcacccgcgaggtggacgcagaggccgcccgaagcggcgtactgacagacgaccgggccgccgtgggcggcgtgctcgcgggcgaagaagccgccatgggcggcgtactgcacgagatcgacgaactggaagagatcgaggagaccgcatgatcggcgtggcgccaccggcgtacgacccggccgccccgacaacggcgaacaccctgccggtcggcgcccccgcgaccgtacgcgcctacgtggccgaactgttccgacggcaccgccgtgcctttctgatcctcatcgcggtcaacacggtggccgtcgtcgcctcgatggccggtccctacctgctgggcgcggtcgtcgagcgggtctcggaccacacgcgcgaactccacctggagcgcaccgccgcactgttcgttctcgcgctcgtcgtgcaggccgtgttcgtacgggaggtgcggctgcggggggccatgctcggcgagcggatgctggccgatctgcgcgaggacttcctcgtacggtcggtcgggcttccccccggcgtgctcgaacgggccggcacgggtgatctgctgtcccgcatcaccacggacatcgaccgcctcgccaacgcgatgcgcgaggccgtgccgcagctgaccatcggcgtcgtgtgggtcgcgctgctgctcggcggcctcgccgtcacggcaccgccgctggcgcccgccgtgctgctcgccgtgccgctgctggtgatcggctgccgctggtacttcaagcgcgcgccgtccgcctaccggtcggaggccgcgggatacgccgccgtcgccgccgtcctcgccgagaccgtcgacgccggtcgcaccgtggaggcccaccgcctcggcggccggcgcatcgacctgtcggaccggcgggtcaaggagtggacggcctgggagcggtacaccctgtggctgcggacggtgctcttcccggtcgtcaacctcacccacgtcaccgtgctgtgctcggtcctgatgatcggcggggtgttcgtcctgcaaggctggatcgacgtcggccagctgaccaccggcgcgctcatcgcgcagatgctcgtcgaccccatcggcatgatcctgcgctggtacgacgagcttcaggtcgcccaggtctcgctggcgcgcctggtcggcgtccgggacgtcgagccggtcgcgggcgacgagtcgctcgccccggacggccgcgacgtgcacgccgaccgggtccacttcggctaccgcgccggagtcgacgtcctgcgcaaggtgtccctggaggtcgcgcccggcacccggctggccctggtcggcccgtccggcgcgggcaagtcgaccctgggcaggctgctcgccggcatctacgcgccccgcgacggccgcatcaccctgggcggcgccgagctgtcccggatgccggccgagcgggtccgctcccacgtggccctggtcaaccaggagcaccacgtcttcgtgggctccctgcgcgacaacctgctcctcgcgcgcaccggcgccggcgacgccgagctgtgggcggcgctgggcgcggtcgacgcagacggctgggcgcaggcgctggacgacggcctcgacaccgaggtcggctcgggcggactcgcgctcaccccggcccaggcccagcagatcgcgctggcccggctggtcctggccgatccgcacacgctggtcctggacgaggcgacctcgctcctcgacccgcgcgcggcccgccatctggagcggtccctggcccgcgtcctcgacggccgcaccgtcgtcgccatcgcccaccggctgcacaccgcccacgacgccgacgtcatcgccgtcgtcgagaacgggcagatcagcgagctgggcagccacgaccagctggtcgcggccgacggagcgtacgcggcgctgtggaggtcctggcacgggtgagacacggcggccaagccgctcggccggcccgcccggttcacttcgggggacgacggtccggccgcccgatcccgctacggcgaggcggcccgcttgggaaagacagcgcgcttcgggaaggcggcgcgcgtcggaaaggcggcgcgcttcgggaaggcggcgcgctgccgaaaggggtacggcccttcggcagcggcacgaccaccttttcggtggcggggtgcggctgtccgggccccggctgcccgcacgatgatccacccgcccggccatgcccccctcccccgcccgccaccggcccgtctctcaccgtcgggccggtgccggggaggggcatccgagcccgacgtcgacggagatctgcgtctgccgccgggccggatccggcccggcggcggcagtcatcccgtcgtgccgttgcgcagtgccgaacgggggtggaaggctggatagcggcaccggctcggggagcgtcccggaccacccggttcaccagggcgcagcctgtgccgagcggacccgcgccgtcggcgaacacgacggcaccggatccgcccccaccacctggaggtacccgtggacagcgccgagggatggggagacgacgtctatcagcccgacggatccgagatacaggaggactcgggactgctcgacaccgaggacaccctggtctccgacggtgtgagcgacccgctcgaccggggctggtcatcaccggaccggccgtgggcggtggagcgctccgacgtgaccgcggccgagcgccgccacggcgagacgctggaccagcgcctcgcggaagaactccccgacatcgcggagcctgacggcgacggcatcggcgactgtccggacggcgacggcgaacccctggacaacgaggtgggcgcggcccgctccggtcggctcgtggctcccgacgaaggggcgcacgaggacgaggagaacgggctgatcgccaccgacgtgggcatcgacggcgctgccgcctcggccgaggaggcagcgatgcacatcgtcgacgaggacgccctgtccggctgatccggacggccatccgtgcccgatggggccgtacacgcgtacgcgcctgatccggccggacgcgtctgatccggccgcctccgggctttccccgcctgcgcgagagccgtatccgggctctccccgcccgtgcgagaccatgcaaggagcacccatgcagcaggacaagcagcccgactaccaccccgtcgtcttccgcgaccgcgccgccggctatgccttcctcacccggtccaccgcgaccagcgacaagaccatcgagtgggacgacggagagacctacccggtggtggacgtggagatctcctcggagagccacccgttctacaccgggaaggcacggacggtggactcggagggccgcatcgcccagttcgagcggcgctacggaagcacgggaccgggctccgacgggggcggtgcggcctgagccggaggctgaggaacctgaggctgaggagcctgagggaggcctgagcggcctcggcagcggggcgcgcccgcgtgcgctcagatgaagttcagcgccgccgcgcagcccaccccgcccagcagcatgaacaccggcatcagcaccttcagctcgacccagctgcccgcccggaaccgcatcgccttgggcggccccaccgggtaccagcgcttgcggcccaccgggatcggccacaggatcgggcagccggagaccgtcagagcgtccccgatgtcgtgcaccagggcacccagaacgatcggcagtccgagccacaggtactcctggcccggcgccgtgaacagccagtcggaaccgttgcccggcttgtccaggactcccgcgaggatccaggcgctggtcgcggccagcagccacaccaggacgtcgctgctcgaaccgcgggccgcccgccacagcagcccctcgatggccagaaccatgtgcacgaagagaagcgcgagcacggcccagcggccaccggtgatggccaggaccgacgcacccgcacctatcagcaccgcccacagccatgtgtgcgtcagcgtacggtgaccacccgacctgcgtgggtcgccctgcttcctggtccccttgtagacggcgtacgacagcttgtcgacgatctcgcacagggttcgtgagatggggccgaaggcccgcgagatcgtggccgccttgtgatccagatcgggggccagagcagcacccgcgcagatcagcgcgccgaccagcaggaccggccagggcatcgtgtggcccgccgcggccgccgccgctccgacgccgagccaggccgccgcccccgacagtgagtgtgctggtcccatcatggccctgtcccgccccatccttctgctgccgctgcccagttgcccgtgtgctctgacgctctgtcggcgccacagcgtagcgttcgcgatcttcgtgcgggcatccgattcccccctcgggtgcgatgacaggcaagatgggggcgtgacccttatcgatcagctgccgcagaccgcagaccccgacgccctctacgaagccttcgagtcgtgggccggggaacgcggtctcaccctctatccccaccaggaggaggcgctgatcgaggtggtctcgggtgcgaatgtgatcgtgtcgacgcccaccgggtccggcaagagcatgatcgccgcgggcgcgcacttcgccgccctcgcccgggacgaggtcaccttctacaccgcgccgatcaaggcgctcgtgtcggagaagttcttcgagctgtgcaagctcttcggcaccgagaacgtcggcatgctcaccggcgacgcgtccgtgaacgccgacgcgcccgtcatctgctgcaccgccgaagtcctcgcgtccatcgccctgcgcgacggcaggcaggcggacgtcggccaggtcgtcatggacgagttccacttctacgccgaggccgaccgcggctgggcctggcagatcccgatcctggagctgccgcaggcccagttcatcctgatgtcggcgacgcacggcgacgtctcgatgttcgagaaggacctcacccgccgcaccggccgccccacggcggtggtccgctcggcgacccggcccgtgccgctctcctacgagtacgtggtgactccgctgacggagacgatcaccgagctgctcgcgaccaagcaggcccccgtctacatcgtgcacttcacccaggcgcaggccgtggagcgggcgcaggcgctgatgagcatcaacatgtgcacgcgggaggagaaggacaagatcgccgagctgatcggcaacttccgcttcaccaccaagttcggccgcaatctctcccgctacgtgcgacacggcatcggtgtgcaccacgccggcatgctgcccaagtaccgccgtctcgtggagaagctggcccaggccggtctgctgaaggtcatctgcggcacggacaccctgggcgtcggcgtgaacgtccccatccgcaccgtgctgttcaccgcgctgacgaagtacgacggcacccgggtgcgcacgctgcgagcgcgtgagttccaccagatcgcggggcgcgccgggcgtgccggcttcgacacggcgggcttcgtggtggcccaggcgccggagcacgtcgtcgagaacgagaaggcgcttgccaaggccggtgacgacccgaagaagcgccgcaaggtggtccgcaagaaggcgcccgagggtttcgtcggctggacggagaacaccttcgagaagctcatctcctccgatccggagccgctcacctcccgtttccgggtcacccacacgatgctgctggcggtgatcgcccggccgggcaacgccttcgacgcgatgcgccatctgctcgaggacaaccacgagccgcgcaagcagcagctgaggcacatccgacgggccatcgccatctaccgctcgcttctcgacggtggcatcgtggagaagctggacgagccggacgcttccggccgcatcgtgcgcctcaccgtcgacctgcagcaggacttcgctctcaaccagccgctgtcgaccttcgcgctggccgcgttcgaactcctcgacccggagtccccgtcctacgccctcgacatggtctccgtggtcgagtcgacgctcgacgacccgcggcagatcctcgccgcccagcagaacaaggcgcgcggcgaggcggtggccgcgatgaaggcggacggcgtcgagtacgaggagcgcatggagcggctccaggacgtctcctaccccaagccgctggaggagctgctcttccacgcgtacgacacgtaccgcaagagccacccgtgggtcggtgaccatcccctgtcgccgaagtccgtcatccgcgacatgtacgaacgcgcgatgtccttcaccgagttcgtctccttctacgaactcgcccgcaccgagggcatcgtgctgcgctacctcgccagcgccttcaaggccctcgaccacaccgtccccgacgacctcaagtccgaggacctcgaggacctgatcgcctggctcggcgagatggtgcgccaggtcgactccagcctgctggacgagtgggagcagctcgccaacccggaggagatgacggccgaggaggcccaggagaaggccgaccaggtcaagccggtcaccgcgaacgcacgcgccttccgcgtcctcgtccgcaacgccatgttccgccgcgtcgaactcgccgccctcgaccacgtcgaagagctgggcgagatggactccgactccggctgggacgcggacgcgtggggcgaggccatggacaagtactgggacgagtacgaggagctgggcaccgggccggacgcccgcggcccccggctgctgatgatcgaggaggagccgcagaacgggctgtggcgcgtccgccagaccttcgccgaccccaacggcgaccacgactggggtatcagcgcggaggtcgacctcgcggcgtccgacgcggagggccgtgccgtcgtcaaggtcaccgccgtcggccagttgtgagcacaggagaatcccacccatgacgaacccagccgagaggctcgtcgacctgctcgacctggagcagatcgaggtcaacatcttccgtggtcgcagtccgcaggagtccctccagcgggtcttcggcggccaggtggcgggccaggccctggtggccgccggccgcaccacggagggcgaccggccggtgcactcgctgcacgcgtacttcctgcgcccgggcatacccggcgtgcccatcgtgtaccaggtcgaacgggtccgcgacggacggtccttcacgacccgccgggtcaccgcggtgcagcagggccgcacgatcttcaatctgaccgcctccttccacaagtctgaagaggggagcttcgagcaccagttgccgccggcccgcgaggtcccggaaccggagtcgctgccgacggtgacgcaggagatccaggagtatctcggcgcactccccgagacgttggagcgcatggcccgacgtcagcccttcgacatccgctatgtggaccggctgcgctggaccgccgaggaggtcaaggacgccgagccgcgcagcgcggtgtggatgcgggccgtcggcccgctgggcgacgatccgctggtgcacacctgcgcgctcacctacgcgagcgacatgactcttctcgacgccgtccgcatccccgtcgaaccgctgtggggtccccgcggcttcgacatggcgtcgctggaccacgccatgtggttccaccgtccgttccgcgcggacgagtggttcctctacgaccaggagtcgccgatcgcggtgggcggccgcggactggcccgcggacgcatctacgacctggaggggcgcctgctcgtctcggtcgtccaagagggactcttccggccgctgtagggaaacagcagcggacctccaggggggcggccgccgtcgccgtggaccagcagcggacctcaggggtttctgcggcgcagccatccgaacaagccacccgatcgctgcgcctcctcgctcgcgcctgcgagatccacggcggtcgtcgtctcgggcggccgctcgtcggggacgccctgggaagggcgcggagccggccggtgctcccgggcttcggcgagcgactggctcaggtcggcccgcagccagccgatctcgtcgggggcgtccgccgtcatgatcctcgcggtgagcacggctgccggggagtcgtgggtgtcgtgggcggaccgcgcgggcctgagccggttcagcagggcacgctcgtaagggtcctggacgatctccgcgacttgggcggggtcgagcagcgatgccacgacggcggccttctcccacggatcctcggtctgccgcagctggaatcccaggtgtcgcccgcgccagttgcggggccgcagatccaggcccgcgtcgagttgatcgcgcaacccttccggagtacggccgctcagcagtcgggtgttctcctttccggcggcgaactgccgtagctcttcggccagatacagccagaccacggccctgtagcggttgaggtagaacttcaccgggaccaccagtcccagacgcgcgaagcgggtgaacctggcgggcgtcactcccatgagcgccgcgccgtcccgggtgcccaagaccgtgacgcgctcccgcagtgcttcggggaagccgtcttcgtctcgcacccggtcgatctccgctcgggcgacgcgcggtcctcctcccttgtcgtccgggaccgtacggacgtacccgagctgtacggccagctcgaactcgcctcgcctgagccccagttcccgcgcggctcgggtgagtgcgacgggagtcgacatggcggtcttcgacctgatggtccgtgacggcgcggtctgtgacggcacggcctgtgacgtggcggtctgtgacggcatggtctgtgacgtggcggtctgtgacgtggtggattgcgtgatcgtgtctccggacatggcggttctcccccgtggagccggttgctcgcgccggtctgcgctcgcttcggaaaaccgtagccggatcgccggatctccgttccggcctgtggataactccaccggcgtcaccgttttcgcaggtcagagatctacggtcggcgttttcttctccggctggcgtgcgtccacgccgaggtgctcgccgacacggttcacgagcagagtcatctcgtaggcgacctgcccgatgtccgcctcggccgcgctcagcacgctgagacagctgccttcgcccgccgcggtgacgaagaggaccgcgtcgtcgaactcgatcatggtctggcgcacgcgcccggcaccgaagtgccggcccgagcccttggccaggctgtgcagtcccgacgagatggccgcgagatgctcggcgtcctcgcgtcgcaggcccgtgctcgccccggtcaccagtccgtcgttggacagcaccagcgcgtgtcgcacatgttcgacgcgctcggtcaagtcgtccagcagccagccgagccccgtgttctgcgccatagtcctagctccccgtgttgtcgctccccctggccggaggatccgatcagccagccttccccacctccaccgtgcgggcaaggaggatgggcggcatggcacagaagatgaccgaagaggaatggcgggcgttcgtctcgcacggcacccgtaccgggaaactgtccacggtgcgcgccgacggcaggccgcatgtggcaccgatctggtttctgctggacggggacgacctggtgttcaacacggcgcgggacagcgtcaagggccggaatctcgcccgggacggccgggccgccctgtgtgtcgacgaggaccggccgccgttcgccttcgtcgtgttccaggggcaggccgagctgtcggaggacctcgacgaggtgcgcctctgggccacgcgactcggcgcccgctacatgggcgaggagcgggccgaggagttcggcagtcgcaacggcgtgccgggggaactcctcgtccgcctgcggatcgacaaggtgctggcgtactcggcggtcgccgactagcgcaaacggatccggctcgtcagcccactgagtccagcagccgggcggtgtgcatccgcccggcgtactcgacgagccggatcagcacctccttgcccgagtcgcggtcgcgggcgtcacagagcaccacgggcgtgccctggtcgaggtcgagggcacgcgacacgtcgtgggcaccgtaggtgcgggcgcccgcgaagcagttgacggccaccacgaacgggatgtgccggtgctcgaagtagtccactgccggaaagcagtcctcgagccgtctggtgtccgcgaggacgaccgcgccgagggcgccctgcgacagctcgtcccagaggaaccagaaccggtcctggcccggggtgccgaagaggtacagggagaggccggatctgatggtgatgcggccgaagtccatggcgacagtcgtggtgaccttctggtccactccgtcggtgtcgtccaccgactgccccgcctcgctcagcagttcctcggtccgcagcggcctgatctcactgaccgcgcccaccatggtggtcttgcccacgccgaatccgccggcgaccagtatcttcaacgccagggcggtcgtctcgacattcgtggcgtcggagttctcggagaccatcgctcacttctctcgggagtttgtccatcgtctacagcgccctcaggcctgcgatgacttcgcgcaggatccgctcgtcgggcagttgtgcgggcggcaccgggcggctgacggtgacacagcccagctccaacaggtcgccgaggaggaccctgacgactcccacgggcaggtcggcgcccgcggcgagttcggcgacggactgtgtctcgacgcggcacaggtcgatgagggcgcggtgctccgggcccagtgacgtgtcgtcgtcgacgcggggcgcggccgtgtcgagggtgacgagcgcgatgaggtcgaagcgcaccccggtggggccgggtttggtgcggccgcccgtcatggcgtaggggcgcacgagtggtccggcctcgttgtcgtaccactggctgcccgcttgcagcgcggagcctggcctgtcctcggtcatctgcggccgccttcggtcgtcatccggcggtgggcggccgcgcggcgatccgcgccggtgtgtacaggtgctcgccgacgcgcttcaccagccgcgccatctcgtacgccaccaggccgatgtcggccgtgacggcggtgaggagggcgaggcaggagccgtcgcccgcggccgccacgaacaggaagccgtcgtccatctccaccatggtctgacgcactccgccggcgccgaagtgacggccggtgcccttggccagactgtgaaaaccggaggcgacggccgcgaggtgctccgcgtcctcgcgcctgaggtccgcggaggcgccgaccgcgaggccgtcgttcgacagcaccaccgcgtgccgtacctctgccacccgcaggaccaagtcgtccagcagccagtcgagttcgccgggccgctggtcggccttcatgcccgggtcctggatcatgcggggtctccttcgctgctgtcaccggcggggccggccgcacggccgggtgagcggccgccgccgcgcgcccagccgtcccggtaggccgccatgcggtcccgtacgagttcgggggtgcgctcctcgtcgtcccggaccccgtgggtgtgtggcgccggttcctcggggcgctgtcggcgcaactggggtgcgagactcgcctgccgtacccgtcgcggaaggtcgtccgagccttcggggtcgtcctgttccccggcctccgggccctccgcgtccggggggcggtgcagccgtagggtggcgacgccgggcggcggattctcgggcgtggtgtccggggctgcttccacggcggcgtgcacggggggcaccagtgcgggtcgcccgaccgcctgctggacggactggtgcgaggcggcggccacgcgcgcgtacgcgggttccgcgtcccgcccggtgtcggccgcacgggggacacgctccgccgtgccgctgtgcagcagtgcggtgggcagcagcacgacggcggtggtcccgccgtagggcgaggtccgcaggtgcaccttgatgccgtgccgggcggcgagcctgctgaccacgaagaggccgagccggtcactgtcgaagaggtcgagggcctcggactgttcgatacggcggttggcctcggcgagtgtctccttgcccatgcccagtccccggtcctcgacctcgacggcgtatccgttgccgacgggttcgccggtgacgcgcacgcgtgtgtggggcggcgagaactgggcggcgttctcgacgatctcggccatgaggtgggtgaggtcggcgaccgcggctccgacgacggaggcctcgggaagttgtcgtacctccacgcgcgcgtagtcctcgacttcggacacggccgcgcggaccacgttcgtcagcgagacgggcatgcgccaggcccggccgggtgcggccccggagaggatgatcaggctctccgcgtggcgccgcatgcgggtggtcaggtggtcgagccggaagaggtcgctcagctcgttggggtcctccgacctgcgttccatgctgtccagcaggctgagctgccggtgcaccaggatctgactgcggcgggcgaggttgacgaagactccggagatgccgctggcgagttccgcgcgttcgacggcggcgcgcagcgcggcgcggtgcacggtgctcagggcttcggcgacctgtccggtctcgtcctcggcgggcggccccggcggggcttcggcgcgaacgtcgatctcttctccggcccgcaacttgcgcatggcctgcggaagtttgcggcgggcgatctccagggcgctgttgcggaggctgatcagctcgatgacgaggccgcgaccgatacggacggagatgaccagtgaagcggccacggcggcgagtccgaagaggacagcggcgccggccggcgtgagcaggccgcgggtgagggggtcggcccggtccgcgacgccgcgtcccgcgtccgcctcgatggtccgcatgccctcctgcacgcgcgcgtgggccgggtcccaggtggcttgcggggcggcggcgatccgcctggctccgggacggttggcgagcaccttgtcctcggcggtgcgtacgtcggcgtacgcgcgccccgtcgcgacgccttgccaggcggctcgttcgcgttcgctcaggtccgcgaccgcggagtcggtcagggtacgccgagtgtccacggcgccggtgaacagccgcagccgttcgccgtcgagggtgcccgcgagccgcgcgctggacagcaccgcgtcctcctgggccagcgcctcgcccgcacgggagaattcgagcagtacgcgcgcgtcggagccgagatcggcgtcctggatgccggtgagcgcgccgccgacgccgaaggccgccgcgatcgtcctggtgtactgcccgaaggtctcgtcccagcgggcccggcgttcgagcaccgcgccgcgcagggagcgcagttgctcggctccgctgacgaaggtctccaggcgcccgggcacttgggcggggaggtcggcgccgtcggcgacggtgtggtgtccgccgagccgcagcttgtccaccgcccggtcggtgcgtgccgcgagcgtccggaagccgctgtccggttctgcggagggatcaatcacgtggcgtacggcggccgcgcgctcggcctggagcgcggccacggcggcggcgaccggcgctcgcactgtcgtgtcgacctgctggacctggcgcagccgtgccacgtcctgggccgtgctgacagtggcgtacgcccagagggcgagcagcgagacgacgggcaccatcaacaggcagacgatcttggcccggacggtccggggacgcacgccccaccgtcccgcgcccacgggtgagtcggccgatgcggcggtgacggtctcgtcggtcccggtgtcctcgtcggcgggctggcccgcgtgggcgcgccggccgcgcaccgggggccgggacggcggctcggcgccggctgatggggtcctacgggatgtacgcatggcctcctcgctcggagtggttcggggcgcgccgcccgggtcctcgccggtcccgggccgccgctagcgggcgacgctctccaccggctgctgggccgacgcggatgcctcgcgctctccggcggtcggcgacagcgcgacgaacgccgatgtcaggaagaggtaggacccgaggccgacggcgagggggaagatgaactgcatcgccgtggccccgggcaggacctccccggcagggctgacgcgcacgcggaccgcgatcattccggtgtagtgcatgctgctcaccgccacgcccatgacgagggaggcgacggcgacggcgatcggcgactggatgttgagggccgcccacagggccgcggtcgccgcgaccacggcgatcaggacggagagtccgacgagcaccgggtcgtagtgcacgacgccgtgcagccgcagcgccgccatgcccaggtagtgcatgctggcgacgccgagaccggtggtgaggcccccgaggaagagcgcccgggcgcggtcccggccgtagccgacggcgaagaccccggtgccgacgacgaccatggcgaccagcaggctgagaatggtcagtggcacgttgtagcggatctcggtgccgctgacgctgaagccgagcatggccacgaagtgcatggtccagatgccggtgccgatcgcggaggccgcggtgatcagccagttccggcgcgatcgcccggtggcgccgagcgcgcggacggtgcagcgcagcccgagggctgcgccgatgcaggccatcacatacgacagcacgggggtcagccagccgaaggcggcgtggtccaggtgtcccatggcccagggacgctagtccgcacaagggcgcacaaggggggcgcatttcgaaaggtgttgaaatatgacacagagaggtacaggagcgaccgcctcacgttcgaacgtgcgcacagcttcgtactccgtgccggtgagggatcatgcggtgcatgagcgacgaccacacacacgtccaggagttcttcgaggcgcgggccgccgactgggacagccggttccccgacgacgggcccgcgcacgcggccgcggtcgccgagctggggctgcgcgagggcgaccgcgtgctcgacgcgggctgcgggacgggacgcgccctgccgtcgctgcgtgccgccgtcgggtcctccggtgtggtcgtcggcgtcgatctgaccccggccatgctggcggccgccgcacgggccggcaggggacgcgacgggcacctcctgctcgccgacgtgaccaggctgcctctgggcacggaatcactcgacgccgtgttcgcggccggtctcatcgcccatctccccgaaccggcggagaacctgagggagttggcgcgagtggtgcgagccggcggcactctcgcgctcttccacccgatcggccgggcggcgctcgcggcgcgccaggggcggcagatcaccccggacgatcttcgcgcggaggccaacctcggcccgctgcttgccggttccggctggcgtatgacgtcgtacgtcgacgaggacgcccggttcctggcgctggccgtacgcgtgaagtgacacagccgtacgcgtgaggtgacacatcagggcacgccgacgacctctgcggcaaaggcgtccgggttgtcgaacatgacgttgtggccggcgccgggcacggtcaccacacgtacacccgccgcctccaggtcccgcctgccctcgacttcaccgctcagttcgccctggagatagacgcggtccgcggtcattccttccaggaggcggcgcatcgtgggggtcgtgccgcgtgcgaggttcaccgcggtgcgatggagggcgcgcgggtcggcgagtcgcatcgtcgccgcccaggtgggcccgatcttgtccagcacgcgcgcgtggccaccgttgtcgacgtagtcggcctcctcgtacgaggcgatgccactgctgccggccttgacgggagggtacggatcgaggttggcctcggacagcaccagtcgcgagacgagaccgggtcgccggtgggccagcacgatggcgaccgccccgcccatgctgtgggcgacgatctccgccccgctcaccccggcctcgtccagcgcggcggagagcgcgtccgcgtggtcctccagggtgtagccgtagtccgcgggccggtcgctgatgccgtgtcccgggagatccacgaacagcgtgcggcggccggccatttcgggccgcgccgcgatgtgcgcgtggtacaccgtcgaggccgagcccagcccgtgcacgtacacgcgtgccggttcgaagcccggcgtctccgtccaccggatcatgcttcccctgccgtcgaactcagcctgcttcatcgccctctccttgcttccgccatcgattccgtcgccttcaagagagtacatcggttccgatgtatagatagaccgatgtagagaaaaagtgatgtagggagggagcgatgtacagcgagagtgaggcagaatgcgcagcatgctggagttggccatcctcggatttctgtacgacgcgccgctgcacggctacgagctgcgcaaacgcatcacggccctgacggggcacgtgcgacccatcgccgagagcacgctgtatcccgcgatcaagcggctggagacggccggtctgctgaagcgggcgacggagccgggctccgtggcggccccgcgtcacgtcctcacactcaccgaggacggcaggcgcgagctgcgccggcggctggcggaaccggttcagcgcgacatcaccgacgagaaccgctggttcacggtgctcgccttcctcaggcacctggccgaccccacggctcaggccgccgtcctgcggcgccgactggccttcctggaggaacccgcgagcttcttctacgagggcgaccggccgctgcgcgcggaggaactcgacgaccccttccggcgcggcattctcaccatcgcgcgggccacgagccgggccgagctggactggctgcggaccacgatcggctcactcgacgggagcggtggctgacgtccccgagtgccggaccggacagcccctcacccccggcaccggagtggtgccgagctcgccgacgcggtagccgttcggatagcccttgacctcccagttgcgccgcgcgaagtgcggcgcccggcgcggcggcagcagacgcaccatccggccccgtgcccgcaccgcgcggcgcaccaacgcacgggtggcggcgcccggcggctcgtaccggaaggcccgcaggagcggttcgtcgagcagggcgaacgtggaggtgcgcaacagcggcgcgagagggccgggataccaggaggtcatcaggcccagcgtcgcgtcggcgacccggcgcgcatccgcgtcccaggcgaaatgggcctcttcgtaggtgtcgagacagtcctcgaactcctcgtaggtccctgggatgtccttgatgcccatgtgccgccccagagtgcggtagtacacggtggtggcgacgacctcgtgccgggagagcctgcgccaggcgtaggcgtcgacccaccgtctgggcatcaccacgaacgtggacagcacgtaccgcatgtcgtcgttgctgatgtcgtagctgcggtgcatctggttgatccggcggatcgcgctgcgcccttccgcaccgtcgaagccgtgctcgacgacggcgtcgagaagcagcgcggtgtcgtcgtagcgcttctgtgtgcggtccgtgagttcggccgtctcggcgagcagccgcccgatgctcgggacggcgtacgtgcggtacagcgccagctccagagcccgggtgaagtcccatgggaactcgtaggccgcggtcagccggtagatcttcagcgcgtccttctccgggtccatccgacggatctgttcgagccgctcgaagcgcttcaccgtgccgtcccccttctaccgacgaagctccaactttacggtgaacagcgtcagatgggtgaggggcgacgtcagtcgcacagggggaaggcggcacagatgttcggcagactccgcacgtccttcagcaggtttcgcaactccatgcgtgtggaggcggccccgcgcgggggcaagcagaaccacaacctgttcgaagcggccgccgcctatgtggccgcgtgcgccgaggacgaccaggagcggatggacgaggccgcgacctgggtgtcgcccgaggcgctgtcgttcggggtgagcgagctggcgtgccgggccgtcatcgcgctcgcgcgggaacgcgacgagtcgtcgcggaccgtggcgcggaccctcctcgggctgcccatggcctgacaccgtggacgtaatggccgattcgcccccgtccggccggatattcacccctgtccggccggatatctgcagctccaggtgtgcttcgcagtcgtgacaaccggcttcgggtcgcattagggtgcgccgacggaccaagcgatggggagggtggaatggccgggacggacgaagagaccgtcgccgcccaggacgacgcgctgtatgtgctgacggcggtgctgttgacgcccgcgaagtttcccagcgtgttgggtgacgactatccggaagcctgcgcggcgctcggtctggcgccgctcgccgacgggtacggcctcgtgctcggccaggacggagatggcgcgcggtggaccgtcgtcatcgacgatgtgtcgctggtggccgtggccatcgcgtcatgggactgcggcatggagtacgacctgtcgcccgaggagcacacggtcgtcgccgcgctgcccggctggcccctggcggtcgccgtcgcggcccccggtgtgccggctccgcatgatccctcgcccgaggtcacggatctcgagccgctgcgtccgccggactgcgagacctggggttccgcgcagcggcgcctgggtgcggacgagatcgcgctccagtgggcgacctggcgggggcagatcggcgacgactacttcacgaaccggaacggcgaagcgtcggccgaggaacccgtgaaagccgacgacggtgacggcaacaacgagaacgacgccggcgacgacaacgtcgacagccggaacacgccgcgtcgcggcatccgccgtgtcctcgcggaggcgcgctcgtacgtggacactccgccgccgctgggccgtgtccggtcctccttcgcgcccggcgacgcccgcaccctgcgtgcggacgggcccggctggtccatcgtggcccggacggacgacatcgcgttcgtcctgctcgacgaggagcccggagaggtccttccggtgggccgtggtcccgagctgcccggccttctggaggcactcgacaagatggcggtccgcccggcctgatccgggtggacgggtcggcacgcgtcgcaaggcgccgcccgcaggacgggctgccggcaggcccgcgggcggcgatacggtcggcgcccgtgcgccgacgggctacgcaccgggcggacgagtgctcagcggccgagttccttgcgcgtgacacggcgcagcctgcgccgctgtgcggggtccagtgccagatacgcggcggccggcactcccaggatgatcaggagggcggcccaccagggaagccagatccacaggatgagcccgaccaccacaccgccggtggcgatcttcgcgttcttcgacatgtatgtcgcctccttcgcggccactgccgctctctgtcctgagaacgggtgcatgctgcgcgcggttccagctcgcgaccctgatacaaccctgagaaacctcggcctccggctctcgaaggcctcatgggtactggctccgcagaggctcgcccacctcgcgcatgtggcgcagggcctgccggtaggagtcgacgagcccggcctccacgtaggagatacccgtttcgcggcagtgggcgcgtaccaggggctgggcgaggcgcaagtgggggcggggcatgctcgggaacagatggtgctcgatctggtagttgagtccgccgaggaaccagtcggtcagcggaccgccccggacgttgcgcgaggtgaggacctgtcggcgcaggtggcccaagcgtgtggcgtcggggtcgggcatttccatgcccttgtggttgggtgcgaaggacaggcccaggtggagaccgaagagtgcctgatggacggcggcgaaggcgagggccttgccgggggacatggagacgagcagcaggcaggcgtagccgatgacgtgcgagaccaggagcagggcctccaccgtccgttcgcgcggcggctgacggcgcaggtcctggaagccggacaccttgagggcaatgccttcgaggagggtgagcgggaagaacagccaggcctggttgcgggtgagccagcgtcggaagcccacccgttccctcgcctgctcactggtgaagaccaggacgtcggcggcgacgtcggggtccttgtcgatgtggttggggttggcgtggtgacggttgtgcttgtcgttccaccacgcatagctcatgccgaggagaaggttgccgtggatcagtccgatgaggcggctgacggacttgtcgccggtgatctgggagtgaccggcgtcgtgacctatgaacgcggtgcgcgtggagagcacggcgagcaccggggcgaggagcagcacccaccaggaggtacccatcagcaggacgcccgtcacgaccgacgccagggccagggcgttcagggcgatctcgcgcgcgtaccagccgtgtcgccgctccagcaggccctgccccttcacggtgcgcaacaggggcgcgaattcactgcccgcgtgctgtccggagagtgtgcccggaggtggctccgtggcgactgctgcgatgtggggcatggtgggactccggtctctcggacaacgagctgacctgatgaaacgtagggacaagcggccgccggcgaccatggcgccaccacccgtgtgcgtaccgggatctcccccggcccttcaggggggttgactccacccccctccgcccccaacgccaagtgactgccttcaccgcaccggtgcccacgccgcgcctgtggagtgctgtactctcgaccaccctgactcagtagtcaaatttgaggaatgcgctatcgctgtgcagaggatgcccgcggcgacccccgccgagatcaccgaagtggcccgctgctgtgccgtgttcatgcccgccgaaccggcccgcaccggtcgcgtcgccttctggcggcccgacggcgacgcaccgcccgccgtcgcgggcggctcggtcgaagagctgaccgtcgttctgcccggcgacgagggtgtcgaacgggtcgccgtaccggccgtgctgctgtcggtgcgtgccgctctgccggtcctcacgcgcgcgcgtgctgccgcgcacacccaccgggcgaccgcgttctggggcaccgccggagtgctcgcgctgcaactcgtggcgcgggggctgctgctgcccggcctgaccgccggcgaccacgatgcgtggcgggcgggtccgctgcgcgccgaggacctggaccgcatccgtgacctggccgccgcgatgccgcccgaggcgcacgccgtgccgtgggccgacaccgagccgctgcggctgcccggccccgagccgctgctgcgcgccttcctcgacgcggtcgccgacaccctgccccgctcccccgccgcgccgctggcggcgggcggcccggccttcgcggcgcgagagccgcagcaggtgcccgaacagcgggcctgggccgcggacgtcgccgccgggcacgacgccggcgtacggatctccctgcgcgtcgaggtaccggggctcgcgtcgatcgcacccggggaggcgggctcggccgcgtcgcgagcggaagcatcggccaggccgcaggagaggtcgtccccgggcccggaggagacggcgtcgaccggatcggcggcggtgcaccccgccttgcgcgccgtactgcaagtgcacagtgtgagcgaccccgcgctcgttgcggacgcctccgccgtgtgggccggggcgcgggccttcgggccgcgcgcgcggatggacgtcctgctcgcgctgcaccgtgcggcccgggcctgggcgccgctcgccccgctgctctcggccgccgtaccggacacggtcgacctcgcggacgacgaggcggccgaactcctcggtgagggctcccggatgctggccgcggccggtgtcgacgtgcactggcccaaggaactcgcgcgcccgctgacagcccgggcggtcatcggcccgccggacggcgggcaggggaaggaccgagccgcgtcggacgtgccgtcgttcctgtccgccgacgcgctgctcgccttcagctggtggttcgcgctgggcgaccagcagctcacgcgggcggagctggacacgctcgccgaggcgaaccgccccctcgtgcggctacgcgaccagtgggtcctggtcgacccgcgggaggtgcgtcgcgcccgcgcgcagcaggaccgcaaggtcacacccatcgacgcgctcagcgccgttctgacgggctccacggaggtcgacggccgccgggtcgacgtccgggccacgggatggctcgcggccctgcgggagcggcttgcggccccggaggggcaggcgccggtcgcgcagcccgccgcgctcgccgcgacgctgcgggactatcagctgcgcggcctcggctggctggcccggatgacctcactggggctgggcgggtgtctcgccgacgacatgggcctgggcaagacgatcaccctgatcgccctccatctgcaccggcagtccgacgattcggcggccggcccgacgctcgtcgtctgcccgacctccctgatgggcaactggcagcgggagatcgagcggttcgcgcccggcacgccggtgcgccgcttccacggctccgcgcgcagcctggacggggtggcggacggcgggttcgtactcaccacgtacggcacgatgcgcctcgatgcggagcggctcgccgaggcgcggtggggcatggtcgtcgcggacgaggcacagcacgtgaagaacccctactcggccacggcccgggcgctgcgcacgatcggcgcacacgcgcgcgtggcgctcaccggcactccggtggagaacaacctctccgaactgtgggcgatcctcgactggacgacacccggcctgctcggcacgctcggcagcttccgcacgcggtacgcgcaggcagtcgagggcggccgggaccccgcggcggcggagcggctcgcccggctcctggggccgttcctgctgcggcgccgcaagtcggatccgggtatcgcgccggaactgccgccgaagaccgagaccgaccgcaccgtgtcactcaccaaggagcaggcgggtctctacgaggcggtggtgcgcgagacactcgcggagatctccggcgccgacagcatggcgcggcgcggcctgatcgtgaagctgctgaccgggctgaagcagatctgcaaccacccggcgcagttcctcaaggaggagcggccgaacatcgcgggccgctccggaaagctggaactgctggacgagttgctcgacaccatcctctccgagggggcgggtgtcctggtcttcacgcagtacgtgcggatggcccgcctgctcgaacggcacctggcggcgcgcggagtgccgtcgcagttcctgcacggcggcacgcccgtccacgagcgggaggcgatggtgcaccgcttccaggagggcgaagtgcccgtcttcctgctgtcgttgaaggccgccggaacgggactgaacctgacccgggcggaacacgtcgtgcactacgaccgctggtggaacccggccgtcgaggcgcaggccaccgaccgcgcctaccgcatcggccagacccggccggtgcaggtgcaccggctgatcgcggagggcaccatcgaggaccgcatcgccgacatgctgctgcgcaagcgggagttggccgatgccgtgctcggttccggggagtccgcgctgacggagctgaccgatgcccaactggccgacctggtggaactgcgagggggcgcacgatgaaggaccgggacgaggaacgtacgttcgcgccgttgccgcccgcacacgggcggggtttcgcccggacctggtggggccaggcctggttgagggccctggaggacgccgcgctggactcggagcaggtgaggacgggccgtcggctcgcgcgcgcgggcgccgtgggagccgtgtcggtgcgccccggaggcgtcacggccgtcgtccaggaccacgaccacaccgcgcaccgcgccgacgtactactccaggagctgtccgaggagcagtgggaccgcttcctggacatgaccgtcgaacgggccgggcacatcgcggcgctgctcgaccgtgagatgccgccgcatctggtcgaggacgcggcggccgccggagtcgaactcctgccgggcctcggcgatctggaggccacatgcgactgcgacgcctgggaccactgcgggcacaccgccgcgctctgctaccagatggcgcgcctgctggaccaggatccgtttgtgctgctgctgatacgggggcgcggcgagagcgagttgctccacgctctccaggcccgcagcgccgtctcccctcaggagccgtcggccccggacaggcccctggagggcgtggacgccgccgagacgtacgcgaccggattccttcttcctccgctgcccgggcctccggaactgcccgcggagccggggctgccgccttccctggacaccgaggtgcccccggcgcccggcgtcgatccggacgcgctggggttcctggccgcacgcgccgcgcacgaggcgcaccgactgctcgccgaggccctgcggacggggcatgaacagcacgtggccgaggaggagttgacgcccgccgaggacgcggtccggctcgcggccggcgccccgggaacgaccgtcgcggcccggctcgccgacggtacgggccgtgacggtgaaggactggcggcggccgtacgcgcctggcactgcgggggcgtggccgcactggccgtactcgaggacgactggacggcggagccggaagcactctcacgcgcgcgtgccgccctggagtcgtcctgggacgaggacgagcgcccccgtctgcgggcgtcgggcaaccgctggagcgtggtcggcgggcgggcgcaggtccgtctgggggcggagggccggtggtggccgtaccgaaaggaacgtggccgctggctgcccgcgggcccggcggcccaggatccggcgacggcgctggcgctggcgctggcagcgacggacggggaagaaagaggctgaggaggtggaggtggaggtggtgcgagcccgggcacgaccggcatacggcggcaggccgcgcacaccggcacgcccggcatccggcgcccgcagccgtctcggctccgggcgccgctcggtcagctcacgcctcggccgactccgccgccggggccgccttgcgcagagtggtgatgcacatcgtgatggcctgctggagctcctcaaggcgctggagcatgtcgtcctcgtagatcgtgtcgaggtcgtcgacgtcgtcgaaggtcagctcctcgaagaccctcgtcgccctctggaggctgctgtagaacttcgtacggcgctcctggaggcgcagttcagggtcggcggcgaccgtctgggcgacgaggtccttcacggtgtcgtacgcgtccgtggcccactgtccggcctcttcgtcgtcgtccagctcgtcgatgagggacagatgccgctcggcctccgcccgcagctcggcgggggcgtcgatcgtctgcccggccggcgtcttgacctgaccgttctcgacgatctggcgcacgtatccgatgcggtcggcggcccgggtctcggtggcgaccgccttcttcagctcgtcggtcctggcgatgtcgcgcgccagctccgtctgcagggccgggtcctccttgagccggtcgagcagcgcggcgcgggccgcctgggcggtggaggggtcggcgaggatcgcggcccgcagcgcggtcgggttctcggcgacctccagcgccttggtcggccggatgccctccgcctgggccgccgccgcgatcgcggtcccgcgctccgaggcggcgctggagcgcgaggtgtagtacgacagccacacgtccgcgtccggcagctcgatgtccgcgccgggaaccagcacctcgaagtgcgggacgatcccgtcgtcggccgccttgtcccaggccttgtagtagcgcatgacccgctccgccgagcagcccgccagtgcggcgaactccttcgcggacaccttgggcgtctcctcggccgactgcccgccgggccgcacgctgcgcgccaccttcaacgcgaacgcccagccgccggtccgcgcgtacaccccgaactcacgggcgtcccgggccaccggctcgggcacgtcgaggacaggggcggagttctccgtcgccgcggagccctccttcgatgcggagctctccgtcgatgcggagtcctccatcgacgcggaaccctccatgggcgcagcgtcacccgacgcagccgcgtcacccgacgacgcgacctcgctcgacggtgcagcgtcacccgacggtgcgacatcgccggacgcgggtggctcgacccagaactcctcgtctgcggacgtctcttcggcaggcggaacggccgcttcggacggagcgatcgttacggtcacaggggactctcccaggcgctggcggacggtacggacggcatggaaccgaagcgagcagcctatatgaacctgttgctacggctttgcacacctctccccggcgcccggcacgcggccctgcctcagcttccggccgcagccgcgatgtccagggcggcgatgtacccgaaggtcatcgccggcccgatcgtcgagcccgcgcccgcatagctgtgccccatcaccgcggcactggcgttccccgccgcgtacaggccggggatcaccgagccgtccgcgcgcagcacacgcgcgcgtgcgtccgtgcgcaggcctcccttggtgccgagatcccccgggacgatcttgaaagcgtagtacggggccagccacaggggggccagacaggagttcggcacgatcgcggggtcggtgtagtagtggtcgtacgtgctgtcgccgcgctggaagtcggtgtcgtcgccgctcagggccaggctgttgaaccggttgacggtggcccgcagggcggccgcgggcatgccgatccgcccggcgagggcgtccagggtccaggccttgtgcgcggcgccggagtcgtaccaggagccggggaacgcgagcgtcggcgcgacgtccttgaagaggtagcggttgcggtagttctggtcgacgatcagccaggccgggatgtccggggcggtcgggttccgctcgtacatggtgtggacgacgtcgctgtagggggcggcttcgttgacgaaccgcgctccggcggcgttgacgaggaggccgccgggcagggtgcgttcggcaagacagaagtagggctggtcgggcagcgggatcgtcggtccccaccaggcgtcgtccatcaggtcgagcgcggcgccagcccgctcgccggcccggatgccgtcgccggtgttctccttggcgcccacggtccacgcggtgccgatgggttggcgctggtactggtcgcgcatggccgcgttgtgctcgaacccgccggagccgacgacgaccccgtgccgggccctgaccagaccggccgagccgcccttggccaccactgccccggtgaccgtcccgttctcccggtacagatcggtcagcggggtgttcagccacaccggcacctgggcggcgagcaggccggcgcgcagacccgcggccagcgactgccccatggtgaggggcttctggccgaggagggccgccttggtcccgcgggccaggcattccgcggcgacggcgaggcccttggcgctgaccgcggacagggtgagccacttgtagtcggcgctgaagacgaccatgccggccgggacggccatgtacgacgggttcaggtgggcgagttcggcgccgaggatgttcccgtcgagctggtcgggttcgatggagcggccgttcggcagcccgccggagagctcggggtagtagtcgctgtacccctccatccagcggaagcggagcgggctgttcgccatgacgaaggagatcatggcgggtccgtggccgaggaaggcgcgctgccggtcggcggagacgtcgggcccgacgaccgccgcgaggtaggcggcggccttcgccggggtgtcggggacgcccgcggcgaggatgacggggttgttcggaatccagatgcccgcgccggaccgcgccgccgagcccccgaaggtggccgccttctccacgacgacgcagctcagcccctgcttcgcggccgtcagcgcggcggtcataccggccgccccggagccgatcacgacgacgtcgtacgtgccgaggaggggcaggtcggccgcgtcggcggcgccgccgacaccggggagcccggccgcgagcgcaagccccgcacccgtcccgccgagcacgcggcgccgcgacgggccgaccgcggagagggattcgatacgtctcgcagggtccgcacttgtggacatggcaggtcgctcctgtgtggcgagggaacgtggggtcgtgcgccgcccaggaccatgaccaaccctggacgcaaggattctgatggagagtcaggaatgtcgcgcgagggtcttgtgaagtcaagggcgtcagcgcgtcggaccttggggcggccggttgtccccgtgcggccgattgtcagtggctcctggcacgatctccggcatgggagttcgctacgactacttcgccgctgccgacgacgccggggccctggcccgccttcacggggacctgggggcggtcgacgacgagttcggcctgacgggtctcaagggagcggacccggatctcatcctcgggccggtcgaagcgggcctcaccgggcgttccgtggcggaggtggaggacgacccgcgttttacgcgcctgatcagtgatccgcaggccgaggaccgttgcctggtcactctcaccgggacattgcgtgatgccctggccggggcgcggccggagcgcctggggcagaccgccatgacggtggtgtccggccccgaggactcggcgggctgggacgcggacctgctcgccgacttccttcagcggctggccgagctgagcaggcacgcgcgcgtgacgcaccaacagctctactgcctcatatcgttgtgagtggcggtgcccgtgacggcttgatgtcctcggcgatatcgataccggcagcccgtgggccaccggtatcaccgagcctgtcggtcagtgaccgctgatggccctgggtacgtacggctgctccaactgctcgatctccttctcggacaattccaggtcgagcgcggcgaccgcgtcgtcgagatgcgccggcttggtggcgccgacgatcggtgccgtcaccgcgcgttggtgcagcagccaggcgagggcgacccgggcccgcggcacaccacggtcggcggcgatccgggccacggcgtcgacgatctcgtcgtcgccctgccggtacagggtcttgccgaactcgtcggtccggctgcgggcggtggtgacgtcgcgatcccgcgtgagacggccccgagccaacgggctccagggcagcacgccgaccccctggtcctcgcacagcggcagcatctcgcgctcctcttctcggtagaggaggttgtagtggttctgcatggagacgaaccgcgtccagccgttcagccgggcggtgtactgggccttggagaactgccaggcgtacatcgaactggccccgacataacgggccttgcccgccttgaccacgtcatgcagggcctccatcgtctcctcgacgggggtggtcggatcccagcggtggatctggtacaggtcgacgtagtcggtccccaagcggcgcaggctgttgtcgatctccgtcatgatcgccttgcgggacaggccgtggccgttgggtccttcgtgcatgctgccgttgactttggtcgcgaggacgatctcctcacggcgtgcgaagtccgccagggcacggccgacgatctcctcgctggtgccgtcggagtagacgttcgccgtgtcgaagaagttgatcccggcctccagcgcctgccggatcagcggccgcgaggcctcctcgtcgagggtccactcgtggggcccacggtcgggaaggccgaaactcatgcagcccacgcagatccgggacacatccaggcccgtcgaaccgagcttcacaaactgcatgcgcactcctgctctcgccgggaacgggcttgccacgcccagcccgacggtacccggggaacacccacgcggcatccccgtacgcggccatcaccagccaacttccgttcctgtcagcccagttgtcgacaggcaccgaccaaccggtgaattccgccgacgtcgaggccgcggacacgccggcatgtccgctccccaaaaaacgcgccctcacccaaatggcccagtaaatccattacgcacctaatcaaacgattaagctcggtccggatccataagggcgagcatccctctggctggcgcttccagctgatgcctgatgtctgacacctgacacctgacacctgacacctgacacctctgcaccctctcgggcggcacccgttccgcatggaaggaacctcctcatggctcatggcatttccctccacatcggactcaacggcgtcgaccgcaccaaatacggtgggtgggacggcaagctcatcgcctgcgagaacgacgcacgcgacatggaacagctcgccaaggaagccgggatcaaagagcgcacaacgctgctcacccccgaggcgacggtcgacaacatcaccgctgagctgcgcaaggcggcgaaggtcctcacagccggcgacctcctgctcttcagctactcgggccacggcgggcaggtacccgacctcaatggccccgaggacgagtcggaccggctcgacgagaccatgtgtttcttcgaccgggagtacatcgacgacgagctgtacaaggaattcgagggattcgccgagggcgttcggattctctgcttccttgactgctgccacagcggcagtggcatcagggtgcgagaaattctctcgccggaggccatggaagaacagttccagacgaccgaccccaaccaggtcgagacaacggccaggatcatgcccctggacatgcaggctgagatgtacgaccggaacaaggagttcttcgacgacatccagcgcaagctcaacgccaaggacaaccgcgacctcggcgcgaccgccctgctcatctcggcctgccaggacaatcagctggcagccgacggcctgcgtaacggtctgttcaccgcgaccgtgcttcaggtctggaacggcggcaagttcacgggcgggtacaaggcgtttcaccgcgagatcctcaagcagatgccggccatccagagcccgaatctgttcatcaccggccgggccaacaaccggttcatcacggagcggcctttcacgctctgagagatcgggcgagaaaatgaccgagagccccgcctcaccgaagtgagacggggctctgatctacgactatgagtgaacctctagtcgggacgacaggatttgaacctgcgaccccttgacccccagtcaagtgcgctaccaagctgcgccacgtcccgatgcgcttcccgcggtgatctgcgtgagcgcgctgacagaactttaccccacgtcggggggtgtcccgaagggggcgcagggcgcgggacaattgcggtatgaacgggacatccgaagtacatgcggacggcgggcgggaccgggacgcggaggggcgggcgcggaacgccaggccgcgggacgggctgggccggcctctcccctacggggtggacggggtggcgcgccagccggaaggcgtcgtacgcagccccatggacaccgtcaccgaggcgcaggccctgctggacgccgggaagcccttccatgcccacgaggtgttcgaggacgcctggaagtccgggcccgaggaggagagcggcctgtggcgcggcctggcccagctcgccgtgggcctcacacacgcggcccgggggaatacgacaggcggcgcccggctgcttcggcgcggcgcgggtgccgtcgaggagtgggcctcgcgggcgggtcgggaccggccctacggcatggacctgacggacgtcgtcgcctgggcgcgggacttggccgcggacgtggaacgcgacgaggaggccatcgacgcgggggcgtcggcgccacggttgcgggggagcacgccccggtagacgagtgcggatgcggatgcggtgcgcggactgtcagtggcgtgcggcagactcggggcgtgcgaaagattcttgtcatcggtatcggtgcgggcgaccccgaccagctgaccttgcaggcggtcaaggcgctgaggagcacggacgtgttcttcatcctggacaagggcgaggtgaagtcggacctcgtccagctccgccgtgacatgctcgacgcgcacatacaggaggggacgtaccggctggtcgaggcgcgtgaccccgagcgcgaccgggccgccggcggcgccgcgtactcccccgccgtcggggactggcgcagcgcccgcgccgagatctacgagcggctcatcaccgacgagctgggcgaggacgagtgcggggcgttcctcgtgtggggcgaccccgcgctgtacgacagcacgctcggcattctggaggagatcctggagcggggcgcggtggcgttctcgtacgacgtcgtgcccggcatcagcagcgtctccgcgctcgtggccaagcaccgcaccgggctcaaccgggtcgcgcggccggtccagatcaccacgggccggcgcctcgcggagggcttccccgaggatgtcgacgacgtggtggtgatgctcgacgcccaccagaccttccggcggtacgccgaccaggacatcgacatctactggggcgcgtacataggcacgccggacgagatcctcgcctccggccccatcgcggaggcggcccctcgcatcgagctgctgcgcgcggaggcccgggagcggaagggctggatcatggacacgtacttgctgcgcaggcatccgcgggattaggggacccggtgggcagtggccggcccacgccggcctcgggctgatcggcgctcgccgccgcatacctccggaggttctggtgccggtcttcgaccgcgtggtcgaggaggagctgtccggcccccgtcggctccctcttccgtacctggccaacggcacgtccacctggacatcggcgccggcctcgggcgaatccggccgagggcggcgcgggaagccgctccacagtccggcgaggcggcgaatacgggcgtgctcgccgccacgcgtccttgtcatactcctgccatgtccgccgccccgacccgtttccgggatctccgcgccacgaagtacgacttcgtggactcggttctggtccgctgcccccgctgcgagcgcatcgcccatgtcgagcggcggccggatcccgacgggcaggccacctcggggatgctcggggcgaggcggctcgtctgccgtgcctgcgggtacgcgcggacgtggcagggcaggtcggtgatgttctccggcagctcggccgccccggcccgcgatccgtatttccgcgccccgctctggctgcagaccgggacacgccacggacggctgtgggcgtacaacctcgaacagctcgactacctcgggcggttcgtcggcgcgccgctgcgggagcgggcgccctggtacgacaccgggcagaagatgacgtacgtggcccgcctgcccgcatggatcaagagcgccaagaaccgcgacgaggtgctgcgcgccatcgaccggctccgcgtctgtgtcacggcaggctgaggccgagccgagccagcgctccggcgacgtccgggacggcggtcacgccctccggcagcggcgggcggcgtacgacgacgaccggcagcccgagttcccgcgcggcggtgagtttcgccgcggtcgccgctcccccgctgtccttcgtcacgaggacgtcgacgcggtgctcgcgcagcagcccgagttcgtcggccaccgtgaacggtccccgcgccagcaccacctccgtgtccggcggcatcggcggctcgggcgactccaccgaacggacgacgaagtgcagttcggcctggtgcgcgaaggccgcgaggccgaggcggcccgtggtgaggaacacgcggcggccgagttccggcaggaggtccgcagccgccgggagtgaagcgaccgcgtgccagcggtccccgggccccggccgccagcccggccggcgcaggacgaccgccggcactccggtcgccgccgcggcccgggccgcgttcgccgtgatgcccgcggcgaaggggtgcgtggcgtcgacgaccgcgtcgacacggtgctcgcccagccacgcggccagcccctgcgccccgccgaacccaccgatgcgtacgtccccttccaccgtcccgggccgggagacacgccccgccagcgacgtggtcacgcgcacaccggggcgcggtgcgagcgacgcagcgagttcacgtgcctcggtggtgccgccgaggaccaggacgtgcagggacatgccgtcgactctagagctgtctcagcgcagcaggagctgggcccctcccaccacggtcgccgcgatcacgagctgttcgaacagccgctggttgatgcggttcaccgcccacttgccgatgagggcgcccggtacgacgaagacggcgagtgccgcgtccagcagcagtgagtggccgtcgatcagaccgaggcccacgctgaagggcaccttggacacgttgacgatgaggaagaagaacgccgaggtgcccaggaagccgagcttccggaagcccgcggagaggagatacagggacatcaccgggccgcccgcgttcgcgaccatcgtggtgaagccgccgaggacaccgtacgagcgggccttgatccggcccgtgcgcgtggccaccgcctccggttccccggtcctgtccgcagtccgtcggcgccagaccgtgaccgccgccatcagcagcaggatcgcgccgatcgacgtccgtacgatcccgtcgtccgcccacaccaggaacagtgtgccgaacacgacgcccgccgcgacggccgggaacagccgccacagcgtgggccagtgggcgtgccgccggtaggtgaggaccgcgaggacgtcaccgacgatcaggatgggcaggagtacgccggtggaggcgcgggcgggcaggacggccgcgaagatcgcgagactgaccgtgttggccccgctcacagcggtcttcgagaagccgacgagcagggccgcggcggcgagggcggcgaactcccacggggttatgtgccaaagcgtcatcgtgttcatgcggggaccgatgctatgtccacgggtctcgccgcgtctcgccgcgtcaggagcgtctcgacaggtgatcgtcgaccatcggcccacgcacatcaccgcatgtcattgtgcgtaccgcaccctcagctcccgcttgaggatcttcatgctcgggcccagcggcagggcgtccgtgaactcgacgcgccgcgggtacttgtgccgccccagatgctccttcgaccactcggtgatctcggcggcctccgggacggcgcccgtggcgcgtacgacgaccgcgcacacctcttcgccgtgcagctcgtccggcagtccgatcacggcggcctgggcgacgccggggtggcgcaggagcacctcctcgacctccctcgggtagacgttgtagccgccgcggatgatgacgtccttcttgcggtcgacgatccgcaggaagccctcgtcgtccttggtgccgaggtcgccggtgcgcagccagccgtcgacgagcgtctcggcggtggcttcggggcggccgaggtaaccggagaagacgttgtggccccggacgacgacctcgcccagctcgccgggcggcagcagttcgacgcgtccttcgacctcggcacgcgcgatctcgacgtccacgccccacagcgggtgcccgatggtgcccgccctggtgccgaaaacgggctggttcacggtcgcggtcggcgaggtctccgacagcccgtacccctcgtagatcttcgcgccgaacgcctcctcgaagcgttccagtacggcgagtggcagcgaggcgccgcccgacacgcagacgcgcagctcgggcagcgcgtccatggctgcggcggcgcccgccagggcgacgaacatcgtcgggacaccgtggaacgtgttcaccccctccttcaccatcagctcgatcgcgcgcgccgcgtcgaagcgcgggagcaggacgagcgtcgcgcccgcgcgccaggtggagttcatggagaccgtctggccgaaggcgtgaaacagcgggagagcgccgagggcgacgtcgtcggggcggatgtcgttggcgtcgaaggcgttgacggtcgcgttcatgaccaggttgaagtggctgagcacggcgcccttggggacgccggtggttccgctggtgtagaacacgacggccgggtcgtccgccgcgcgggtgacgtacgagggcagcggctcggcgatcctggccagcttctcgaactcggcgcccagcgtgatgacttggacgccgacggcctgagcggcggccgtaccggtctcggcctgcgcggggtggcacaggagcagtgtggcgccactgtccttcaggacgtgctcgacctcggacgccgacaacaggagatggaccgggacgaccacaccgccggccgcggcgatcgcgtagtaggcgtgggggaagtcggcggtgttgggcgccatgagcgccacccggtcccccggccgtacgccgagaccgacgagggcgccggcctgggcgcgggcgcgctgccacacctcggcgaaggtgaggcgcagctcgccctcgacgagcgccgtcttctcggggcggcggcgggcgttctcggcgaggatcgcggcgagggagagggtggcggccatggacgaggggctccgtttccttgctggtgcggcggtgaaccagagggaggactcagcggtggtgctcagtcatgcgcgacaaagaacgtggcggtgctcagtcacgcgcgacaaagaacgtagtggcgctcagtggcgttcgacgaggatcgcactgccctgcccgaccccgacgcacatcgtggccaggccgcgggccgcgccggtgcggcgcatgcggtggagcagcgtggtgaggatgcgggcgcccgagcagccgagcgggtgaccgagggcgatggcgccgccggtggggttgacgagctccgggtcgatgccgaggcggtccacgcaggcgagggcctgggcggcgaacgcctcgttgaactcggcctcttcgatgtcgccgatcgtccagccgacgcgagccagggccttctcggtcgcgggcacggggccgatacccatgacgtcgggatggacaccggccgaggcgccggcgacgtactgtcccagggactccagacccagctcgttcagggcctcctcgctgacgaggaggagtccggccgctccgtcgttcatcggcgaggcattgccggcggtgacggtgccgccctggcggaacaccggcttgagacgggacagcttctcgtacgaggtgtcctcgcgtacgcactcgtcgtcggcgacgaccacgccgtcgggccgggtgacgggcagcagctcgtcgtcgaagtacccgttcttgcgggcgtccgcggcgcgccggtgactgcgcagcgcgaactcgtcctggcgttcgcgcgggaccgcgtaccgttcggcgacctcctcggcggtctcacccatggagagcaggccgtgcagttccttcatggccgggttgaccaggcgccagccgagccgggtgtcgacggtctcgatgcggtgcggcagggcctcgtccgggcggggcagcacgaagggggcgcggctcatggactcggagccgcccgcgagcacgatgtcggcctcgccggcggcgatcgtgcgggcggccgtggtcaccgcctccagaccggaggcacagagccggttgaccgtggcgccgggcaccgactcgggcagcccggcgaggagggcggccatgcgggcgacattgcggttgtcctcgccggcctggttggccgcgccccagtacacgtcgtcgatacgggccgggtcgagcccgggcaggtcggcgatcagaccgcgtatcaccgtcgccgcgaggtcgtcgggccgcacgacggacagggcgccgcgcagcttgccgatgggggtgcggcgagctgccgcgaagtggacgggacgcacgacctgactcctgaccgaattcgatccacggcaggtgcaccgcccgccgtcggttaattagcactgctagttttcgactatagccccccggccgtcacctgggaaccctgccgtttcacccgttccttccagggcacgcgaaacagagcaaaggagtcatgacaagccacgaaccacaaggagaagcacggtatgccggttgtgaagagcacgctccccgagcccgcccgccaggtcgtcggcgaggccctgcagcagacgctggtcgatctgctcggactctcgctcatcgggaagcaggcccactggaacatcgtcggaccgaggttccgctcgatccatctccagctcgacgaagtggtgtcgacggcccgtacgtacgccgacacggtggccgagcgggcggcggcgctcggcgtctcccccgacggccggcccgagaccgtcgccgcgtccttcggtctgcagggtccgaaggacggctggctgcgggacaccgaggtcgtacggctgctcgtcgaggcgctggaggcgacggtcggagggctgcgtgagcggatcgccgtcacggagaaggccgatccggtcacccaggacctgctgatcgggctcaccgccgaactggagaagcagtactggatgttccaggcggaggactggccgcgcgacaactgaccaactcgaggagccggccatgcagcaggaccgtcgcatcatcggggaactgatcgccgcgcacggcaccacgtacgccgatgaggcgggcatccggctcaaggatgccccgcagccgctgtaccggctcctggtcatggcctgtctgctcagcgcccggatccgcagttcggtcgccctcgccgccacgcgcgcgctgtacgacgccgggttgcgcgatccgcgccgtatggccgaggccgactggcaggaacgggtcgacgcgctgggacgcggcggctaccggcgttacgacgagcgcaccgcgacccagctcggcgagggtgccgagctgctgatcgagcgctggggcggggacctgcggcggatgcgggacgaggcggacggcaaggtccccgagctgcgcaggctgctgcgggagattccggggatgggtccggccggcgcggacatcttcctgcgcgaagtgcagcacgtctggccgggggtggcgccgcacctggacaacaaggcgctgtccggtgccgagcggctcggactcccgaaggatccccggaagctgatggaacgtgccggtgacaccgagccggccgttctggccgccgcgttggtccgggtggccctggacaagaagtcggcgcgggaagtgctcgcgcgggtcggttgacggggctcggccgtcgaccgacggccgtcaacggacgggcgccgcacggcgccggcggctcgccctcgtcgggcagggccaggatctcgtcccgcagcgcgcgtaaaagctgtcctcacagggcggtgcccgcgcccgttccagcaggcggcggatccttttcccgccctactctgtccatgacgtcacccgtgttcgacccgctccggtccgctccggtctgatggtccgctccggtccggtcacgcgattccaccggcgtcctgacgtgtccctacaagtgtccctacggggatccgtagctttgcggggtcccgacggcgggaggcggtgacgcagaggtgagcgacggatcgcgtcgtcccggctccggttccggccgtggtcgaggtcgcggggggcgacggatgcggtacatcgtgctggggagccggcctgcgcacggggtgggggcggtggcacgggcgcgcaccgcagagaaggcgacgcggcgtgccggggaccgcgacggcgtgaccgtgaaccacgggctgcgggtggccgcggcgtacgcatggcggctgctggtggtcggggtggccgtgtacgtgggcttcatgaccctggggcggttgcagctggtcgccgtggcgctgttcctcgcgctggtcgtgaccgcggtgctgcgtccgccggccggactgctggcgcggcggctgccgagggccgcggcggtggcggtgagcgtggtgggcagcctggtggtggcgctggggctgctggcgctggtcggcggcctggtggcgggcgagtgggaccagctgggccgggagttcggcgggggcctcgggcggatcgaacgatggctggaaggccctcccttccatgtggaccccgccgtgatgtcggatcttcagggcaaggtgagctccttcgtttcggagcaccgctcccagctgatcagcagcgcgctgagcggcgccgggcgcgtggtcgaggtgctcaccgcagcggtgctcgcgctgttctgctccattttcttccttcactccggggacaactactggcactggttcctggcgcggctgccggagggcgcacgggaaccctggggccgcgcgggacgggcggcgtggcggacgttcgccggatacacgcgggggatcatcatcgtcgcggccagcaatgcggtgctggtcgggatcgccctgttcgcgctgcaggtgccgctggccctgccgctgacgctgctggagttcttcgccgcgttcattcccctggtgggttcgcccatcgcgctggccgtggccacggtcgtcgccctggcctcacgggggccggtcgtcgcgatcgcggtgctcgccctgatcgtggtcgtcggccagatcgagggtcatctgctgcacccgctggtgatgagctgggcggtccggctgcaccccgtggtcgtggccctctccgtcatcgccggcagcatcctggccggggtgatcggcgcggtggtggctgtcccgatggtgtcggtcgcctggtccgtgctcagcgtgctgcgtcctccgcacgagccgggcgcgggtcaccccgggcggtcaccgggctgacgcgtcggtgcggcctgccgacacgtcgatgcggcgtgccgacgtgtcgcggccgcgtgccgacgtgtcgcggccgcgtgccgcaacccgagtggcggtgtgccgcatcagacgttcacgctgccgagcccgcgcaccccgagtggctcaacccatcgctccccgtgtccgccacggtgactccggaaggtgtgccggtcaccgaggtggaacggccgggcagccgtgccgtcaggcggagtgggccgttgccgcgggctcctgctcggcgtcgtcgaccgcgtaggagaggaagtcgtcgaccatccggtggaagagggtggccagttgccgcagttcctcgggggaccattcggccagcgccatctgcatgccgcgcgcaccggcctcacggatgcggtccaccgcctcccggccggtggacgtcagctgaatacgctgagcccgccggtcgtcaggatccgggacacgagtgacgtaaccggacttctccaactgctgcacctgccgcgtcacatgcgaagcctccacaccgagccgatgggccagctcccccggccgcaacggctcggtgtccgagatctgccgcagcaacgccaccgcggcccggtccagcggaacccccgccagcgccatcagacgttcatgctgccgagcccgcgtactcagatacgtgatccgggtcagggcccgctcgatcccggtcacttccggcgaggccgaggcggccggcagcgagggcggagagggtgtggacatgcggcacactttaccatatcgttgcgtaactcaagtaattttctccggcagtacgctgccccaaggggccgttgccgggctgatgttgtcccgcacggcctcccgccaggtcgcgccggccgcgatcgcctggcgccagcggcggatcgccctgggcggcaggccggccgcgagggctccggtcagccggtcaccggtgcggtacgcggcgacgaaccggcgttcggccaggtccccctccacgaccaccgtctcgtcgtgggcccggaagtagccgtacgcctgaatcttcatgtcgtactggtccgaccagaagtacggcaccggcgcgaacggtctgcgcgcctcggggcggaggaggttgcgggcggcggccatgccgtgctcggccgcgttggtgcggtgctcgatcctcatggacaccccgaacagcgggttgtgccagcgggcgacgtccccggcgccgtacacgctccgcgcggcttcgccgtacgcgtcgcagaccagaccgtcgcccagcgtcagtccgctgcccttcagccactcggtgttgggcagacagccgatggcgaccaggatctcgtccgcctcgaccacctcgccgtccgcgagccgcaccccctcgtcggtcacctcggtcacggtgactccggtgcgcagctccacaccgtgctccagatgggcccgcgacagcacctcacccacctccgcgccgaccgcgtgggccagcggcaccggtgcgggttcgaggagggtcacgtccgctcccagacgccgggccacggcggcggcctccgccccgaggaagccggccccgaccacgaccagccgcgtgcccggcccgagccggtcccgcagcgcgagggcgtcgtccaccgtgcgcagcacatgcgcgccctccccgggcagccggcgcgggcgcactccggtggccacgatcagaccgtcgtacggcaccgacgagccgtcggccagacgcaccgtacggtccgtcacgtccagcccggtcgccgcgacgccgagccgcaggtcgaggtcgagtgcctccaggtcgcccggcgtccgcagggcgagccgctcgggttcccactccgcggccagcaactgcttggacagtggcggccggtcatagggggcgtggcattcgtcgccgacgagggtgatcgtgccgtcgtacccctcgcggcgcagcgtctcggcggccgtgaggccggccgccgaggctccgacgaccagaatgcgtttcaccgttccaccagtcggatcgccgccgccgggcagaccgccgcggcctctcgtacgccgtcgtggagtccggcggcgggttcctcgtccagcaggatcgcgacgccgtcgtcgtcccgctggtcgaacacctcgggggcggccacgacgcactgccccgatgccacgcacttcggttcgtccagttccacacgcatggttcttgcctctgttccttcgtatgggggggtgtcaccaggtgacgggcagacagcggacgccgtaggtggtgccggtgtggtggaacgcgagccggtcgatcggggcggccagacgcagtgtggggaagcggcggtagagcgtgccgtagacgacctggagctccagccgggccagcgactgtcccagacactggtggggcccgtagccgaatgcctggtggtggcgggcgggacggctcaggtccagccggtcggcctcgggaaaggcctccgagtcccagttcgcggcgtgcagatcgaacagaaggccgtccccggcgccgatgacccggtcgccgatctcgatgtcctccttggcgacccggcggatgccggagtggacgatggtcagatagcgcagcagttcctccaccgcggccgcgatcaccttcgggtcctcggcgtcccgcagcacggccagctgctccgggtgttcgagcagggcgagggtgccgaggctgatcatcgtcgcggtggtctcgtgtccggcgatgagcatggcgacgcccatgtggacagcctcgcggtgcgtcatctcgccggccttgatccggccgcccatctcggacagcacgtccgcgtcgggggcggcggtcttctccgcgagcagggtgtcgaggtaggcggcgagggccccgctcgccgcccgcgcctcctcggccggaacggagttgtcgagcacgaggttgctgttgcgctggaagaactcgtggtccgcgtacggcacaccgagcaactgggcgatgaccagggacggcacgggcagcgcgagcgcggtgaggagatcggccgggttcggtccgtccagcatgtcgtcgatcagaccgtcgacgatccgctggacggcgggccgcatggcctcgatccgcttgatgaggaaaggtgcgttgaccgtccggcgcagccgggtgtgttccggtgcgtcggtgttggtgatgagcctcggggtcgcgtgcgcgatctccgcgcggtgcgcgttcacgtaggggaagccgggatcgcggtcgtcgttgctgacgcgggggtcggtgagcagggcgcgctgatcggcgtggcgggtgatgagccagggcgtgctgccgttccagatccgcaccttggtgatcggctgctcgtcgcgcaacggttgcagggcgggcggcggggcgagcgggcagctcaccgcccggggcatcgggtacgcggcgaccggcggggtggcgtcgggcgcgcggcccgccagggcatcggccatgtctctcctcggtggtgggggtccggtcggaaggaagcgccgggggtgacggattcgaggcctcgatgagcacatgcaaacagagcggactgacagcgtccggtcagtttcctgacaaaaatctgacgtgatgcacgtcacatcttctcgccttgccgccggcggaccgaagggcgcgttcaagcccaactaccttgcgcgttccagtcattggcccggcgtgatggcctctgcgccgcactcgcccgaacggcgaagggtggcaccgcgtcagcgcggcgccaccctggaacggaagggaacggcgcttgcccggccacccccgacgtcatctcgtttgctctcaccccagccagtagccgaagccccggcgggtgtggatcagcggcggcccgtcccggtcgaccttgcgtcgcacccgggagacgagctgttcgatcgcgttgcccccgcggaactcgccccggacgaaccggccgatccgctccttcgagagcaccttgttcgcgttgacgagcaggtggcgcagcagccggtactccgcgggcgtcaggtcgagcgcccgctgtccacgccacgcctggcaggtgctgtcgtcgagcaccagatccccgtagcccagtgtgccctcccggcgcacccgccgcctgccgtgcagtaagacctgcgctctggccaggacttcggcgatccgaaggggcttggtgacatagtccgtctcccccggccccagctcgggcagcagccggtccagggagtcgtactcggccaggagcagcacccgcgggcgctcgacgacggcgaggcggggctcctgcgcgagttccgtcatgtccgagaggtccgcgtcgaggaccacgaggtcgaaccgacgcttcacgagccgcgccaccgcctcgcccgccgtatccgccacgctgatccgaaagcccgccagttccatggtcgtcgacagcagttcggcgatctccgggtcgtctacgacaatcagtacgtgccgcccgtctccgcgggcgagcaagggtctctcactggctctgccgtacatggaagaccattcctgtaggactcatgcctcacgcctgaacggcggcggccgggacatgggtgccgtccgatcgcgtcaggccgcgggatgtcccggccccgggccgaacccggggacctcctcgacggcatggacgagaaactcgccgacccgcatcaccctactctccagttgcctgactcaagcaatatccggggagcccctggccgtgggccgttgactcaagccgttcggggggtacgaggacaagcgaggccacgaacgtcgtcatcgccaactcgcccggattgtgaggcagtacggtgccggacttctccagcagggcaggcgtcgcgttcgtcgcggggggcaccggcgggatcggcgcggcgatcgtccgtacgctggcgcggcggggcagcgacgtggtgttcacgtaccgctcccagcaggccgctgccgacggtctcgccggtgaggccgaggcgtacggacgccgcgtcgtggcggttcggctcgacctgggcgacgaggcggccacggcgcgggccgtgtccggggccgccggaacgccgggcgggctccacaccctcgtgtacgcggcgggcccgcacgtaccgatggtgcatctgagcagggtgtcgccgagtcaataccatgcccaactcgcggcggacgcgggggcgttcttcaacctggtccatcccgcgctgccgccactgcgtgagagccggggcagcatcgtcgccgtcaccaccgtggccacccgccggttcccggtccgcgacggactgtcgtcgggcacgaagggggcggtcgaggcggtcgctcgggcgctggccgccgaagagggacgctacggcgtacgcgtcaactgtgtcgcgcccggcatgctgaccgacggcatggccgcacgcctgatcgagtccggcgaactcgacgaggcggcgctggagatcacccggggcaacatcccgctgcgccgcttcggcgatgcgacggacatcgcggaagcggtcgcgttcctggcctcggaccgcgccggctacatcaccggccagtccctgggtgtcgacggcgggtacagcgtctgaccggtcggcgcgctccggtgtgatccggcgtccgtcgacgtacgcggagcaggcacaggtcggcgaccgaaccgaccgccgcccgcatgaccgcctacgggtcgcaggggccgcgcctcccctgaacggacgcttgcgaggcgggcgatcggtcgggccggttcgctcacgccgtcggggtcctccgctcaagtggctgcggagcaaccggtgttgacggtccgccgggcgcgtcgcgagatcagggcacagacccgggccggaccgctctcggtccggcccgggcgcgggtctccgtggtcagccggtggtggacagccgctgcggagcggtgctcccctgcgtccgccgcgggctgcgcaggccggtgaggctcacgaacacggtggccaggacggcggcgacggcgaaggcggtgaagccccagccctcggccttgctcgcgacgagctggccgccgagccacggcccgaagacggctccgaagcggccgatgccggacacccagcccacggccgtggcgcggttgtcggcaccggagcggccggccaccgccgcgtagatcatggcctgggcgctgaagaggaacaggccggtgaggaagaccaccacgtaggtgagcgcgagcggcatgtgaatgccgagcaggtagacgccgacggcggtggccgcgaaccagatggtggcgacgagcggcgcgccgtagcggtcggagaagcggccggcgaccagcatgcccacgatgccgccgaggttgatgacgatgacgaacgacagggaggagccgagctcgtagccagcgccgcgcatcatggtgggcagccagttgctgacgccgtacacgagcagcagtccgcagaaggaggccagccagaacagcagggtggtgcgccacaggttgccgcggaacagtgcggcgagggcgctccagcgctccccggcggcggggcgctccgcctcgggggcgggcatgtcgacgtcgtagcggcgggcgagttcacgggcttcctcggtgcggccccgggcgagcaggaagctcatcgactccggcaggaacttggcgaccagcggcactccgatgaacagcgggaccacgcagatccagtaggcgacgcgccagccgcccgcgccgccggtccacagacccacgaagcccgagaggatgccgccggcctgatgggcggtcatcagcatgccgacgatcagggcgccgcgaccgcgcggggcgtactcggcgaccatcgtgatcgtggtgggcagcaggccgccgaggccgaggccggcgatgaagcggccgagtccgaagacaccgatgctgggggcgaccgcgcacagggcggaggcgagcgagaacaccgcggtgcagctgaggatgaccttcttgcggccgacccagtcggtgaccgtacccgcggacagggcgccgatcagcatgccgaaggtggcgtagctgccgaggtcgccggcctgggacggctcgaggccgagggcgtgctcctccagcatgtggggcagcacggcgccgtagacgaacatgtcgaggccgtcgaagaggacgaccagccagcacaggccgacgaccagcgcggccagtctgctgccgcgagcggacaggtgggaggaggacatcgttgttttcctctcgtccaggaggcgtgtccctggaggggatctgtgaggcgggccgtcgcggctcgtgcggctgacccggtggtgcgctcgacggtaaagagccgccctggaaagtgtcaacgcttttgtcaacaatcttagaaacaatcaagacagtcggccatggccgccgatacggccgcgggagcaggtacgacaaggggtgggcggcacagaactgtgcgccgcccaccccctctgtatggcttgtttcagtcgacgggcggtgtgccgtgggtgtggaaggactcgatggtcttcaggccccaggcctgccccttggcccgctcggcctcggtccaggtgatcagcggccagtcgggggccagcaccagacgggtgagcgggttgcacagctcgatgcggttgccgcccggctcgtagacgtacaggaagaacgtctgctggatggcgtgcttgtgcggaccggtctcgatgaacacgtcgttgtcgaggcagaggtcggcggcgcgcaggatgtcgtcacggttgtcggtcgcgaacgcgacgtggtgcagccgtccgctggaacccgtccagtccgaggtgtagacgacgtcgtacgacttgttggtgaaggtgagccactgggcggccaccttcccgctgtcgagcacgatctgctcggtggcgcgggcgccgagcacctcccgggtgaaggccgcgttggccgcgacgtcggaggcgaggaagttgacgtggtccaggcggcgcacgcccacgccctggccgggcttggcctggggctggttcttcagacccggcttcagctcgggcggtgcctcgtaccactcgctctcccaatacagggcgagttcgtggccgtcgggatcactggagacgtacagcgggccgatgcccggttcgtcctcgacccagcgacccccgcggccggtgttctccagatccttgacccggcgctgaagggcctcctcgctggaggcgcgcagggccgtgcggcgcatccccggcttcccgtgcgcggtgaggatcagactgtggtgctcgtagtcgtcccaggtccgcaggtagacggagtctccggaggtgccgttgacggtcagcccgaggatgtcggtgaagaaccggacactgcggtccaggtccggggtgagcagttcgacgtgcccgaggtgggcgatgtctccgaggggcggagtcatccttgtctccttagctgtggcgcgcgggtgtcggcgcggttgcggcggaccgggggaagacggtgccgtcgaagatctttcgcgcggtacgcacgacggcggtccggcgggccaccggcactgcgcccgcggcgccgtgctcgatgctggtttcgaggtcgaggaacccggtggggtgctcgatgcgcaatcggtccccgtgtgcgggcaggcgcgccaggtcctggccgacgcccccctcgacgcgcagcccggcggccacactcgcggcgcccaggacaccgatggaggtgtggcagcgcaccgggatgaaggtgcgggtcatgatcgcgccgccgtgcaggggcggtgccaggaggctgagtttgggcacggtggtgccgtcgacgtcaccgagccccatcagccgtccggcctccagccggatcgcccggagccggtcggcgagggccacatcctcctccaggtccttggggtcctcgtagcccttgacgttcagtgaggaagcggcgatcaacacggtcggcattccgttgtccacgcaggtcaccggggtgccggcgacgacgtcacgggccagccctgtaggcagcagcggactgccgcccggcgggaactcgatgaccaccggggcggcggtccccggcacaccggagatctcggccgagccggtgtagtcgacgcgtccccccggggtgggaaaggtcgcgacggccaggtccccggtgttgagcatgcggatccgtacggacgtctccgcgtcccccggggcgaccagcccgcgttccacggcgaaggggccgaccccggcgagcaggttgccgcagttctgccggtcggtcacctgggcggtgtcgacgccgacttggaggaacagatagccgacgtccgcctcggggtcggcggagacggagacgacggccaccttgctggtcaggggatgcgccccgcccaggccgtcgatctggcgcggatcggggctgcccatgacgcgcagcagcaggtcgtcgcgcgcgccggcgtcggcgggcaggtcctcggccaggaagtaggcccccttggaggtgccgccgcgcatgagcatgcagcgcacctcccgggtcccggtcacgagcccgcctcctcgcgggcgtactcctcgtaggtgcggtactcgacgccgagccgggcgagggtgtcgcgcagtccgtagcggtcgaggcccagctcgcccttggcgaaggcggcgcgggacgcctcttccttggcggtgcgggcggcggacgcctcgacggcccgggcggaccgctcgcggggcacacacatgacaccgtcgtcgtcggcgaggatcacatcgccgggccggaccgtctgcccgccgatcgcgaccggtacgttgaccgagccgccggtggccttcacggtgccctgggagctcacggccctcgcccacaccgggaagcccatctcacgcagttcttcggtgtcccgcacgcccgcgttggtcaccaggccgcgcacgccccgccgttggagggcggtggcgaacagctcgccgaacatgccgtcggtggagggagaggtggtggtgacgaccaggaggtcgccctcgccgcactgctccaccgccgcgtggatcatgaggttgtcgccgggccagctgagtacggtgacggcgctgccgcagatccgtacgccctgctggatggggcgcaggtcggggccgaggaggccgctgcggccgagcgcctcgtggaccgtggccacgccgtagccggacagcgactcgacgtccttcgcatccgccttgggcgggttggtgacgatcacgccgctcatgccagctcccccgtgacctgcgggtagggacgcatgtacgcctcggcgtacgtggcgtgcggcagaccgaggttgggtccggcgttgcgcttgagctggacaccgcggcgcttgcccaggtcggtgtagtagtcccacaggtgctgctgggcggccaggcactccatggccttgcgcttggtctcccacacctcggtgatgtcgaggaggacctccggcttgaacccgcacatctcgggctggtgcggctcgaagaagaacaccggcggggccccgatgatctccccgggggccgggtagccgatggcctgggcgagcacgcgcgcgtccagggccatccgagccgccgccgggtggtcgccgttgtaggggtcgtcgagggggtgggtgagcacgacgtccggctgggcctgccggtgaacggccaccagccggtcggtcaactcgggcgtggcgagcagggggtagtcgccggcgtcgaagaagacgacctcggcgccgagggtggcggccgccttctcggcctcctcgcgccggatccccttgatctcctccagcgacttgccctcgcgccacgccttggcggattcgccgcgctcaccgaaggtcagacacgcgatggtgaccttctcgccgcgggacgccgccagggcgatggctccgcccgctcgccacacgaagtccccggcgtgcgcggtgatgacgagtgtggaccgtggggtggcgggcgcgttgccgtgcgtcattactgaatctccttggtgaacaggggtgcgcccgcctcgtccgcgtcagtcgcgcagcgcctcgatcacgctggtgaggtgggcgcggacggccacctcggccgcctgcgggtccctgtccctgatcgcttcgatcatggacaggtgctcgttcagggagtgctgcggacgccccggtctcagcgccaactggaagcgatggcgcaccagttgcgcgttgagccgctccagtagctccacggccgtctgctgcccggagaactcccggatcctgtcgtgcagttcatggttgagctccgagtacgtcaccggctcgccgtcggccacggccttggtcatcgccgcgcccaggtccgcgagctcggtcagctgctcgtcgctggccgcgacggccgccttggccgcgcacagcccttcgaggaccatgcggcactcggtgatggcgaccgcttcctccacggtcaccacccgcacccgcgaaccgcggttgcggatccgctccaccagcccttcggccgccagatcgatgagcgccgcccggatgctggcccgcgtcacaccgaactgttcggcgagttcgttctccaccagccgctgcgccggtgccatctcgccgtgcaggatcgcctgccgcagctgcgtcaacgcatgctgcttggcctgctctccagtgctcggacgggcttccttcggcatcgttgccctccctgagtgagtgcctgtcgaacctaaatctagccaagcaagattgtcaacaattttgtcctccatattgcgtgcatgcgtcggcgccgccacggtcccggggcggcgcggtttcgctgtgtgccgggcctgcacgcgagtacggaacgagggacgacccgtcagggaatcctcgggctcgggcgcataccgatacccgtactgtccgaggtactgacgtgctccccggcctgaaggccgggggttcctgccgcggtcttccgaccgtctcggtggcctggtgagcgacaacaggcgctgctgtccaccacggtcagggcgtcagacggaagtaccgtcacaagggatcgcgtctcccgacggagcctcgccgcgcccgtggtggcgggtggtcaccatgtacagcaggccggtgatcaggacgacgcctccgcacagcagcacgacgtagttgtcgaaccacggctgttccggatttcgaggccagcagatgttgatgatggcgaagatcccgtaggccagggcggcggcgttcacgacgagcccgaagcggcccagagtgaactcgcccgcgggttcccagcccttgaggcgggctcgcagcgcggccaggacgaccatctggaacgaggcgtagataccgaggatcgcgaacgagacgatcttcgtgagggcgttctccgacaccagcgagccgaaggcgatcagcgcgggcacgacggccgcgacgagcagcgcgtaggtgggtacggcccgtgccggggagaaccgctccagcagcttgtgcccgaagatcatgcggtcgcgtgcgtacgagtagatgagccggcccgccgccgcctgaaggctgacggtgcaggacaggaacgagatgaggacgacccccatcacgagcctggcgcccacttcgcccatcgcgtcgtacagcacgcgcaccacggggtcggtgtccttgccggagatgacggcccggtagtccgtcaccgacagcaggagcgtgaggcaggtgaaggtggccgcggcgccgcccacgtagatcgtgcggcgcatggcccgggggatgacacggccggggtgctcgacctcctccgcggtgtcgccgcaggcctcgaacccgtagtactggtagaagccgatgatggccgcgccgaggaacgccggcaggtagctgccgtcgccctcggcgccgaaggagtcgaagatgacgccgatgccgtgctcgcgatgggtgaccagcaggtagatgccgacgaccagcgccccgaccagttccccggtgaaaccgatgacggccgcccacgaaagagccctggttcccgcgtagttgatcagggcggccaccacgatgaggaccaccgtgcacccgacggtcgtgtgcacggtcggcgcgaagccgagcaggatcgcgatgtacgggcctgccccgtacgccaccgaggtgatcgtgaccaggagcgcccacatatagacccagccggtcatccaggcccaccgcgggccccacaggcgccgggcccagggatagacgcctccggcgatggggtactgcgccacgacctcgccgaagacgagggcgacgaggaactggccggcaccggccagcaggaacgcccagatcatgggcggtccgcccgcggcgagcgcggtgccgaacaaggtgtaggtactgacgacgggtgacaggtaggtgaagccgagtgcgaagttcgcccacggccccatgtccttgcggaacttggagtccggcacccagccgggttccgagggcttcccgcccggcgagccggctcccgcggtcgggtcgctggttccggccatcagcgtgcctctccgggctgccgcgtccccttgatcagatcgaccgcgcgttccgctgccagcagcacggtcagcatcgggttgatggtgggcatcgtcgggaacagggacgcgtcgacgactcgcactccgctgacgccgcgcacccgcagctgcgggtcgaggacggccagcggatcgtcgtccgcgcccatccggcaggtgccggccgggtggtagacggtgtgcgcggctttccttccgtacgcggacagttcggcgtccgtgcggatgtccggtcccggcgcgacctcccgtttcagccagtcccgcaacggtgcggcggcggccacttcccgggcgatcccgagtccgtcgacgatggtcttctcgtcgtagccctcggggtcggtgaagtaccggaagtccaggcagggctgccgcgtcgggtccgcgtcggccagccacatccgtcccaccgagcgggctctgggtacgttcggtgtcatacagacgccgtgctcgatcgccgggtggccgagccgttcggtgttgaccgtgaacgggacttggtagaagtggaacatcaggtccgggcgcggcccgcgcggagcgcggcgcaggaacagtcccgcgtccgagtccatggccgagttcgggggcagcgggccgtgcgtctcccagacgatgaccgactcggggtggtcgaggaggttctcgccgacgcccggcacatccgcccgcacctcgatgccgagatcgcggagctgctgcgcgggccccacgccggacagcaggagcaggcgcggtgtgtcgatcgctcccgcgcacagcagcatgtcgcgcgcggctcgcaccgtcgcggtggtgccgtcgctctgccggacctggacgcgggtgagacggccgtcaccgtccggcagcagcccgtacgcccatgtctccagccggagcgtcaggttggggcggtccagcacggggtgcagataggcgacggaggcggaggagcgccggttgctctccggctcgtacgccagggagaagaatccggcgccttcggcgaacggccgcgcgttgaagtcctcgatcaccgggaccccgagggccgaagcggcggcggtcacgaaatcgcgggcgatcggattgcggtccttgtcggcgaccggcacgatccggttctggaggcgatgacggtacggcagcagcacgtccggaccccagccggtgcagcccctgtcgacccagtcgtcgaggtcctcgggcagcggaaggaagctgatgaccgtgttgtgcgaggagcagccgccgaggacgcgggcccgggaatgcagaatgtgcgagttcccgcgcggctgttccacggtcgtgtagccgtagtcgaactccgagccgagcaggttgatccagttgcgcaggcgcaggatccgctcgtcgcccacgtcgctgggaccgccctcgatgacgcagacgcggcagtcggggtcctccgtcaggcgggccgccagaacgcatccggccgtgcccccgccgacgatgacgtagtcgtattccggttcgtccgtcacggaccgctccccagccatgccgtcacgcccctcagcccttgaaccagccggaggggccgggagagaggttctggtagatgtgcttgatctcctggtattcgcgcaggcccgtgggtcccagctcacgtcccacgcccgactgcccgtagccgccccactccgcctgggggagatacgggtggaagtcgttgatccacaccgtgccgtgccgcagccgggcggcgacacgctgcgcccggctcgcctcgccggtccacacacctgccgcgagcccgtagcgggtgtcgttcgcgagctcgaccgcttcgtcctcggtacggaacgtctcgacggtgaccaccggtccgaagacctcctcctggacgatgcgcatggaccggtcgcagtcgtcgaagatcgtcggcagcaggaagaagccgtgtgcgaggtccgggtcgtcggggcgccggcccccggtcaccagccgtgctccctcggaccggccgaggtcgatgtacttctccaccttggcccggtgttcggcggagctgagcggaccgctctcggtgtgcgggtcgaggccgttgccgagccggatgcgggaggcacggtcggcgagttcccggacgaagcggtcgtgccaggagtcctgcaccagcagccgtgagccggccgagcagacctgcccggagtgcaggaaggacgcgtcgagcgtgtggtcgaccgcggcctcgaagtccgcgtcgtcgaagacgacgttcgggttcttgccgcccagttccagggcgatgttcttcacctcgcgggccgccgactccatgatccggcggccggttcccagaccgcccgtgaaggacaccaggtccacctccgggtgcaccgtcatcgccgacccgacggtggcgccggcgccgagaacgagattggccactccgggaggtgcgcccgcctcctcgatgagccgcatcatggcgatggtcgtgagcggggtgatctcgctcggtttgaggacgaacgtgttgcccgcggcgagcgccggtgcgaccttccaagaagcctggagcagtggatagttccagggggcgatcagcgcgcagaccccgacgggttcgtggacgacgcggctgagaacgtccgggccggcgtcgacgacgcgtcccgcgtccttgccggccatctcggcgaagtagcggaaggcgttcgacacgtccttgacgtcgatccgggcttcggcaagggtcttgcccgtgttcagggtctcgtcccgcgcgatctcctcgatgtcccgcaggaggtactccgccacccggaacaggacgtccgcccgtcgctgtgtcggcgcggccgcccagtcagcggcgtggaaggcccgcctggccgctgtcaccgcgcggtcgacgtccgtggcatcgccctcgtcgacactgcggacaacggtcgcgtcgaagggattgaccacctcccgtgtcgtgcctgtcgcgccccggacccactcaccgtcgatgaacagatcgggcatcgccgccactcctccgtgcagggccgaagccgtcctaccgccgaacctccaacctgcgtcagcgcccgagccgggccggagcggcacaccgcaggtgcgcgggcgcgggcccataagttgaccccgctggtctacgggcgcctcgcgcgcttgcggtgcggggggggcaggcgcgatccacgggaggacgtgccgacctgccctcgggttcaggcctcgggttcaggcctcgggctcaggactcaggctcagaactcaggctcaggtctcgggctcaggtctcggccggcgcctcggcgggagcgggacgtgcggcgctgtggcatcggcgggcagtgcgagctgaccccttccacgcaaaagggcccccacaggctctcgcctgcgaagacccttcgcacggtcgggacgacaggatttgaacctgcgaccccttgacccccagtcaagtgcgctaccaagctgcgccacgtcccgttgcccgtctgacctgggatttcccctggccgaacgtgcacggaaacaataccgcactccggccggtggtcgcgcactcctttattcggggccgacggaccgggtattcgaggccgacggaccgggcgcggccacggcggcgagaagcaccggccggcgcttgacctgaagtttggttgaggttgcacgatcgtcggtatgacgatcacgacggaacgcggttcccagcagtacgcgtacaccgacctgccccggctgatggggctgatgaccggcgacgagaagcacgggcccgccgcgacgtccacgctggacgcgctgtgggtgctctacgaccgtgtgctgcgcgtcgctcccgagcgggtggacgagccggggcgggaccggttcctgctgtccaaggggcacgggccgatggcgtactacgccgttctcgccgccaaggggttcctgccggtcgactggctgccggacttcggctcgtacgactcgccgctcgggcaccaccccgaccgcgtcctggtgccgggcgccgagatcggcagcgggtcgctcggccacgggctgcccatcgccgtgggcacggccctggggctgcgggcccagggactaggcgagccgcgcgtctgggtgctgaccggcgacgccgaactcgacgaggggagcaatcacgaggcgatcgcgtacgccggtgccgccggcctcgaacgcctgcacaccatcgtgatcgacaactcctccgccacccacgccctgaccggcgggatcgccgcccgcttcgaggcggccggctgggccaccacgaccgtcgacggccacgaccacgaggccttgcacgccgccttcaccgcgccccacgagggccggccgctcgcagtcgtcgcccgtgtccgcccgaaggacgcctgagtccgtctctcctgcgcgcatcggcctcacaccacacagcactcacaccgcacagcactcgccgcccgccgtacgttccgtgaaaggacaccccctccatggacaccatgcgtgaccgtttcgcccccgtcgtctcccggctgctcgacgaggacccccgggtcgtggtcgtcctcgccgagatcggcaaggacggcttcaccgaggcccggcgcaggcatcccgaccgggtgatcaacgtcggtatccgcgaacagctcctggtcggagccggtgcggggctcgccctgaccgggctgcggccggtgctgcacacgttcgccagttttctggtcgagcggcccttcgagcaggtcaagctggatctcggccaccaggacgtgggcgcggtcctcgtcagcgccgcggcctccttcgactggcccgccggcggctacacccatatgtcgcccggtgacgtggccctcctggacacgctggacggctggaccatgcacgtccccggtcatccggacgaggcggagacgctgctcaggcacgccgtggccgcgggcgacgacaaggtgtacgtacggctgtccgtgcagtcgaacgcgcggcgccgcgccgtcgacggcgagcgcttcctgaccgtccgcgagggacgcgcgggcgtggtcgtcgccgtcggcccgctgctcgaccccgtgctcgaagccaccgagggactcgacgtcaccgtcctgtacgcgaccaccgtccgccccttcgacgccgtcgccctgcgccgggccacggagaccgcgggcaccgatgtcgtcctggtcgagccgtacctggcggggacctcgaccgccgccgcgaacgacgcgctccacgatgtgccgcaccgtgtgctcggcctcggcgtgggccggcccgagctgcgccgctacggcagcgtcgacgagcacatggcggcccatgggctggacgcgggatcgctgcggcagcggatcgcggagttcgcgggcgccccggcgcgcgcctgacagccgctgccacggcgcaccgacagcgccggcaggtggtcagtccgcggccggaagccccaactccgggtgggcgtcgatcagtcggggcggagccgcctgccgccaggagtcggcgaggatgtcgcgcagttcggcctcgtcctccagcgccacgagccggacccgcacccaggcgaagccggcctcgtggtcggcgatccagaacttccggggctccgccagggcgagttcgtcgcgctcctccttggggcagcgcacggcgatggaggtctcgtcctccggcacggtggcgaacatcttgcccgcgaccctgaaggtgggcatgttccaggcgaccttctccgtggtgtccggcagggagagggcgatacggcgtacgtcttcggcatccagcatgagtcgcaccgtaaccaacgccaccgacaacgccctgcgggagcggacggcccacagccgacaccgacagccgacagccgacagcggcgccgtaccgtgccgccgccccctacagggccggcggcacaccgtcgcactcgactcccacccgctcgtagaagatcgccggtcagtccacggtcgcggcctccgccagcgcgtcgaggaccggccggatcagcggatggttctccgcgccacggcgtacggccgcgaagacccggcgcgtgggcgcgaccccgtcgacgggccgcacgaccacgcccgtcagctccatgccgcgcagcgccgagcgtggcaccagggccacccccgcgtcggccgaggcgagggcgacgaccgcgcggaagtcgtccgaggagtgttcgaggcgcggctggaatccggcgttctcgcaggccaggaccaccacgtcatggcaggggttgccggggtacgggccgatccagggatccttggccagttcggcgagcgggacctcggccgtgtcggcgaggcggtgggtgacggggactacggcgtcgaagggctccgcgtacagcgggatgtgcgtgaggcgcggatcgtcggcgtcgggcgcaccccggtactcgacggcgaccgcgacgtcgacctgccggtcgaggaccatcggcaggctggcgtccccctcggcgtcctggacgcggatccggatgccgggcgcggtcgtggcgagccgggccagggcgggcgcgacgacgaggccgatgcccgtggcgaaggaggcgagcgtgaccgtgcccgcggagcccgcgctgtacgccgccaactcggcctcggcgcgctccagttgagcgagtacggcgtgggtgtgaccaagcaggatctcgccggccggggtgaggcgtacacctcgggcgctgcgctcgacgaggcggtggccggtctcctgttccagggcggtcagctgctgggagaccgcggagggcgtgagatacagcgcggcggcagccgccgtcaccgtgcggtggtcggccaccgcacggaggatgtggagccgccgcgcctcgatcatgcggtcgattctctcaggtcgggcaaaccggcctgtccgcgcgccgagcagaccggaatccccgggcgcgaaggcgctcggcgcgttcccgcacaccggggcccgccccgcagccccccacaccggggcgccccgaagcgtcccccgcacgccgacgcgacccggatcgtccgtcgcgtcgcgtcgcgtcgcctcagaccggggcctcccccacgtcgggcgaaccgggtcgccgccccctgctcaagcctccaagctcagacctccacgctcaggcctccaagctcaggcctccagctccgcgcgcgcggacacgaaggcgtccacggcccggttcacgtcgtccgtcgagtgcgcggcggacagctggacgcggatgcgggcctgcccctgcgggaccaccgggtacgagaagccgatgacgtagacgccgcgctccaggagcagctcggccaggcggccggccacggccgcgtcgccgatcatgaccggcgcgatcgcatggtcgccggggaggatgtcgaagccctcctccgtcatccgggaacggaacagcgcggtgttctcggcgagccgcacgcgcaggtcgtccgccgactccagcaggtccagaaccttgagggaggccgccgcgatcaccggagcgagcgtgttcgagaagaggtacgggcgcgagcgctggcgcagcagggcgacgatctcggcacgggcggcgacgtaaccgccggacgcgccgccgagcgccttgccgagggtgccggtgatgatgtcgacgcggtccatcacgccgtgcagctcaggagtgccgcgtccgccggggccgacgaagccgaccgcgtgcgagtcgtcgaccatgaccatcgcgtcgtagcggtcggcgaggtcgcagatctcccgcagcggggccacgtagccgtccatggagaagacgccgtcggtgacgatcagccggcgccgggcacccgaagcctccttcagctgtcgctccagatcggccatgtcgcggttcgcgtaccggaagcggcgggccttggacagccggatcccgtcgatgatcgacgcgtggttgagggcgtcggagatgaccgcgtcctcggcgccgaggagggtttcgaagacgcctccgttggcgtcgaagcaggaggagtagaggatcgtgtcctcctggccgaggaatgcggacagccgccgctccagctccttgtgcacctcctgcgtaccgcagatgaagcgcacggaggccatgccgtagccccagcggtcgagcgcctcgtgggcggcggcgatgacctcgggatggtcggcgaggccgaggtagttgttcgcgcagaagttgaggacctcgccggggcggccgcccgccgtgacactcacggtggcggactgcggggtgccgatgacgcgctcgggcttgtgcagaccggcggtccggatctcgtcgagggtggtgcgcagatcgtcgcgtacggaatcgaacatcatcagttccttagagtcctcagagggtccagtcgaggatgaccttgccgccgcggccgctcgccgcgtcggcgaacgccgcctcgtagtcgcggtagccgtaccggccggtgatcacgggagcgaggtcgaggccgccttcgaggaggacggacatcgcgtaccaggtctcgaacatctcgcggccgtagatgcccttgatcgtgatcatggaggtgacgatccgggcccagtcgacggggaactcctgggacggcagaccgagcatggcgatgcggccgccgtgcgtcatgttggcgatcatgtcgcgcatggcctcggggcggccggacatctccagaccgatgtcgaagccctcgcgcaggccgagcgcgcgctggccgtcggcgatggtcgtgtcggcgacgttcagggcgaggctcacgccgatcttgcgggcgagttccaggcgctcctcgctgacgtcggtgatcatgacgttgcgggcgccggcgtgacgggccacggcggccgccatcaggccgatcgggcccgccccggtgatgagcacgtcctcgccgaccagcgggaaggacagggccgtgtgcacggcgttgccgaacgggtcgaagatcgcggccacgtcgaggtcgacgggaacgcggtgcacccagacgttggccgcgggcagggccacgtactcggcgaacgccccgtcccggccgacgccgagcccgaccgtcgcacggcacagatgacggcgtccggcctggcagttgcggcacttgccgcagaccaggtggccctcgccgctgacccggtcaccggccttgatgtcgacgacgtcgcggccggtctcgacgacctcaccgacgaactcgtgaccgagcacgagcggggtacggacggcttgctgcgcccagccgtcccaggaccggatgtgcaggtcggtgccgcagatcccggtcctgaggaccttgatcagtacgtcgccgggcccgatctcgggctccgggacgtccatgagccagagcccgggctccgccttctccttgaccagcgccttcaagctgtggctcctgtggtgaggtcccggagcagggcatgccgaagaagcccgtgccggggaggggtgaatccaagaggttgaatccaaggggtggaaatccctcagaaatctgccgtacggcaccgccccgggtccatcgaggttttcttaagcgccgccacagctttccttcacacctcagccgtttccttccggccacggctgtccggcccgcctcggcgtgcccgggcggctgacccccggccgccctcagatcccgccgctctcccgccgtccgatctgctcgaccagctccgccgccagcgccttgatggtctccaggccggctctcccccacgggcgcggctcgatgtcgacgacgcagatcgtgccgagggcgatacccgtgcggtcgatgagcggggcgccgaggtaagagcggatgccgatctcgtcgacgaccgggttcccggcgaagcgggggtagtcgcagacgtcctccaggacgagagccttgcgccggaccacgacatgggggcagaagccgtagtcgcgggccatgtagcggcgcacgtcgggtggttccgcgccgtccgcggcgggccgaccgcccgaccccgtgccgtcgggtgcgtgcaggcccgcgaagaactgccggttctcgtcgatgaagttgaccatcgcgtacggcaccgccgcgacctccgcgagccggtccgcgaaggcgtcgaagacgggctccgggcgttcgccgagcccgaggcggcgcagccgtcgtacgcgctcgggggcgtccttgtcctcgggcgtcagcagcagccggccgatcggacgcggtgggtcgtagctcatccgcgggctccgcggccgacgacgcggctcatgtgtgggctccgtggctcggggcggtcgccggggcgtgggcgaggagatgccgtacgagcgtgagcagggtctgtacgcccgagctggagatccgggcgtcgcagcgcacgacgggaatgtgcgggtccaggtcgatggccgcgcgtacctccgcggggtcgtaccggtagccgccgtcgaagtcgttgatcgccacgatgaaggcaagaccacgctgctcgaagaagtcgacggcggcgaaacagtcctccagtcgacgggtgtcggcgaggatcaccgcgccgagcgcaccctcggagagttcgtcccacatgaaccagaaccgctgctgtccgggcgtgccgaacaggtagagcacgtgttcggggtcgagggtgatgcggccgaagtccatcgccacggtcgtctcgaccttgttctcgatcccgtcgagattgtcggtcgcggcgccgaccgtggtgagcagctcctccgtgctgagcggcgcgatctcgctcaccgcgccgacgaaggtcgtcttgccgactccgaaccctccggccaccaggattttcaacgcggtggggaagggatcagagctgtcgtcgtagtccatcgagcactgcctccagaagagaccggtcagtggggttgtggtagaactccgggggtttcgtggtgagcgccccgcagtcgacgaggtcggacagcagcaccttggtgaccgccgccggcagcttcagatgggcggccacctcggcgaccgagacgggcgcccggcacagttcgagtgcctgggtgtgctcggggccgaggtagccgaggggggtgaccccggtggccatcacctgcgacaggagatcgagcgccgtggtcggccgtgtcctgccgttgctgaccgtgtacgggcgcacgaggcgtccggccgcgtcatcgagccagggcccatcaccggccgcggccgcgttcaaggccgcatcgccgggggctgcgcggcggcctgccggggcgccgtcatcagatacggccgcacgctcttgaccagcatcgccatctcgtagccgaggaccgccgcgtcggcctcgcggcccgcgagcacggcgagacaggtgccggaacccgcggtggacacgaacagcagggtcgagtcgagttcgacgacgacctgccgtacgtctccgccgtccccgaagcggatgcccgcgctgcggccgagggagtagaggccggaggccagggctgccatgtggtcggcgctgtccgggtcgaggccgtggaccgacttcacgaggccgtcgcaggagaggagaaccgcgctcgtggtgtgcggtacgcgctgcacgaggccgctcatcagccagtcgagatcggatacatggccggtcggggcatcgctcgccatgatggatcgactccttgaggtacgagggtccgcgggagcggagggggtggggggtggggtgttcatccggcgggtgcgctcccgtcgtgccggggggtgaggtcatgtccgggcgcgggcgcgtgacccgcgtgcgcctcggctatgtgtgccggatccatgggagggacgggttccatgggcgtgttgatgtggggcacgccgatgcccgtcggctccggagtcgcgtacggctcgggggcggtgtacgactcgggggccgggtacggctcatgggccctgtacggctcgggggccgcgtccggcgccgacgggaccgtctccaactgctgctgcgcctcggcgagtccgatgccgcgttggaacgccgccatcaggccggggtcgtgtccgatgtaccggccggcgtcctggcggggcaacggcggggggccgtcgcggagttggggcgcgatgtgctcctgggcccggcggcggattctgcggggtctggagggtccccggggcctgcggagtccgtgactgcgtctgctgtccgcctccggtcaccgcctgcgcggccgccccgccgttcatgccctggggcagcgtccgcggtgcttcaccgggtccgccgggcaccgcgcccagcagttcctgcggtacgacgagcaccgcctggacgccgccgtagatgttgctctgcagccgcacgtggatgccgtgccggcgcgcgagctgcgagaccacgaacaggccgatgcggccgtcctggagcaggctggcgacgttcacctggtcggggtcggtgagcagggtgttcatcttgttctgttcgctgagcggcatgccgaggccgcggtcctcgacctcgacggcgagccccgaggtgacgaggttgacgcgcagcagcacctgggtgtgcggggccgagaacaccgtggcgttctcgacgagttcggccagcagatggatgacgtcggcgacggcgtgcccgcgcagagtgccgtcgatcggcggcaccagcttgacccgcgagtactgctcgacctcggcgatcgcggagcgcagcacctccgtcatggagacgggcttgctccactgccggcgcgagacggcgccgccgagcacggcgaggttctcggcgtggcgccggatgcgggtggcgaggtggtcgacgtggaagaggcccttgagcaggtccgggtcctcgatctcgttctccagctcgtcgaggatcgagatctcgcggtgcacgagcgactggaggcgccgggcgagattgacgaagacctcgaccttctgttcgctgcccgcctggctggagagctgcgcggcctgcacgacggcggtgacggcgccgtcgtgggcgcgcgccagctcggccgcgaccagctcgaactcgtcggcgtccgccgcgggcgccgcacggggggcgcggacgggcggcgcctcgccacggcgcagcgtctcgacgagcgcgcgcagctcggcctcgccgcgggcgccgtcggcgcgcagggcgccgaggcggtcgcgtacggacctggcggcgcggtcggcggccacggcggcgatcacgatgcccgcgagggccacgccgaaggctccggcgagcacggcccacagggtgagatcgggccgggcgccggtggagcggacggtgaagagcacggcggcgcagccactgagggccaccgcgatgggcggcagtaccgccaggcgcagcaactggggccgtatgtgggtctcgggcagcgaggggacggtgcgggcgaccggccgtccgtgccgcccgccctcacggcggtctgcgcgtgcggccggtgcgcggaggtgagacatcggagtcctcgtactgggtgcgtcgggagcgtgggctcccgcggatcagcgcgactcgggcatgcgccatcgcggcgtcggtcgagagagccgaaaaaaacggccctgcgtcgcccgacggcaactgacagtagtcggcaacgcatcatgtgcggtgggcagttgacaaagtcccatggcaagcgtcccgctctggtatgaggcgtcgcacagcagaccgataaccccgcccgacccacgttcccctgacgtaccaaaacgatcagagctgatcagaagcggtcttgagcagacggcgagggccgaggagcactgtgctcctcggccctcgccgtcgatcggatttccagcccgcggagccggtgactcagcccgcggcgacggtctccggctctccggtgccctccacggcgccctcggggatgtcacgcggcgtatcgcccgggatcggcccgacggcgggccacccgccctgcggggtaacggccacaccgcgccaccagggctcggacggcacggtctcggccgtgggttcgaagggctcgccggggcggggcagggcgatgcgcgcgccggccgcgcgggcggcggtgatcgtcccctcgccgggctcgacccacgggtgcggcgccaggttgaacgtcgcccagtggatcggcagcatcactccgccgggccggccgccctgaaggtcgaggtgggcgcgcatgccctcctcgggggtcatatgaatgtcgggccagaactcactgaacgcgccgatctggatcatcgtggcgtcgaacgggccgtgttcggcaccgatgtccttgaagcctccgaagtaacccgtgtcaccgctgtggtagatccggtgggtgtcgcccgcgacggcccaggaggcccagagggtgtgctggacgttgcgcaggccgcggccgcagaagtgacgggcgggggtggcggtcagggagatgccgcccaccttcgtcgactcgttccagtccagctcgcgcagccggtccggggagacgccccagtgctccaggtgggcgccgacgccgagcggcaccgcgaagaccgtgtccgtaccggccagggccttgatcgtgggcaggtccaggtggtcgtagtggtcgtgggagatgacgacgacgtcgaccgggccgagggcggccagcggcagcggcacggggtgcagccgcttgggcccgacgaagtcgaacggggaacagcgctcgccccagaccgggtcgaagagcacccggtggccgtcgatctcggcgagcacgctggagtgccccatccaggtcagccgcagtccgctcgccggaggcctggcgaggtcggcgaaggtcgtggggtgcaccgggaccgtgccggccggggagcggcgggtgcgctcctccttgcggaggaacaccttcgccagctccagcgtggagccgccggcggggcgggtgcgggtgccctccgggttcacgaaggagccgtccacgaaattgggtgatctgcggatgcgctccaggcgctcaccgctcggatccgcgccgaaggcggcgggccgcactgcgcggagcccggagctcgggagacggaaaccggtcacggcacctccatgtggagtcggtcaggccttccattatggtcggcccctctgacagcgccgggtcgagcgtgtcacagcgcgatgtcccggcacacagcgcgtcgttcgggcctggatgtcacatccgccacgccccgtccgtcgtaccaacgagggcacccgctcaggagtgccccggacgacgtactggaggtggcccccgtggcccgtgtctccctaaccccgcggcgcacgttcttcttccgcatcgtggagtggtattcgaagcggacgtacggcaaggtcctcgatcccggcaaggcactcgcccaccatccgcgcgtgctgtgggcggacctgcgcttcgagcagtcggtggccaagtggaaccggctcgacccggatctgaaggcgctcgccgagatgacggcggccgcgacgatcggctgcgcctggtgcatggacttcggctactgggtgagcagggagcgcgggatggcccgggagaagctgctcgacgtaccgtcgtggcgcgacagtgcggcgtacacccccctggagcgggacgtcatggagtacgccgaggcgatgaccctcaccccgcccgccgtggaggacgacctcgccgcccgcctcgtcgaccggctcggcgagccggccttcgtcgaactgacggcgatggtggcggtggagaacctgcgttcgcgcatcaattcggcgctggggctgacaagccagggcttcaaggactcctgcgacgtgccgagcgccgaggagcggacggcgtccccccgggccgtgcggcaagattgacagactccgacacctcttcggatactgactgacagttcagtagcggccctgcccgtccccggcctgccgaccgccctggacggcgcgcgcgtgcgggccgggtgaggtcgtcgacgcccccgccgaggcgctcgccgctccccggcccgacgccgatcccctccccgaggagccccgatgaccgcccccttgatgacgctcgcgtggaccgaccacgtcaccggacggcaggggtacctcgtcgtggaccgcctcgtgcggggagtctccagcggcggactgcggatgcgcccgggctgcaccctggacgaggtcgccgggctcgcccgcggcatgaccatgaaggaggccctgcattacaaccccgagggccgctacatccccctgggcggcgccaagggcggtatcgactgcgatccgcgctcgccggaggcgtacggcctgctcgtgcgctatctgcgcgccatgcggccgtacatcgagagctgctggaccaccggcgaggacctcggcctcacccaggacctcgtcgaccgggccgcggccgaggcggggctcgtctcgtccattcaggccgtgtatcccctgctcgacgacgaggccacggcgcgcaagcggctcgcggacgccttcgcggtcgaggtggacgggatcgggctcgacgagctggtcggcgggtgcggggtcgccgagtccctgctggccgccctggaccgggccgccgtgccgtacgcgggtacgcgggtcgccgtgcagggactgggcaccatgggcggggcgaccgcgcggttcctcgcgcgcgcggggctcacgatcgtcgccgtcgccgacgtcaagggcacgatcgcgaaccccgagggcctcgacgtcgaggcgctgctcgcggcccgcgacgcgtacgggacggtcgaccgctccgcgctgcgccccggcgaccgggagctgccgggcgaggcctggctgtccgtcgaagccgaggtgctggtgccggcggccgtgtcgtacgtcgtcgacaccacgaaccagcggcggatcggcgcccggtggatcgtcgaggcggccaacatgcccgtactgcccgaagcggaggcactgctcaccgaacgcgggatcaccgtactgcccgacgtcgtcgtcaactccgggacgaacgcatggtggtggtggaccctgttcggcgacatcgacgccgacgcggacgaggcgttcgcccgcacgcgccgttccatgcgcgcgctgaccgacctgatgctggcccgcgcggaggccgacggaacgacaccgcgcgccgccgcgcacgcgatcgtcgccgaccggctgccggtgatcgcggaacggttcgggtggtaccgctgacgaccgtcgccgacgccccgtcacggggcacggcccgactgccggcccgcaggcgcctgtcacggtgggcggccatggccgctgtgtagggttgccgcgtggcgagagtgcggttgagcgtggcggagcggcgcgaggaactactgcgggcggcgatcgagcagatcgaggcgcggggcgtggcggcggtacggatcgccgatgtcgcggcggcgctcggggtgagcaacgcgctggtgctgtaccacttctcgaccaaggagaagctggtcgccgaggccttcgcccatgccgccgaggacgatctcgcccatctgcgcaagctgctcggccgccggacgtcggcgctgcgccggctgcggaccgcggtgcgctggtacgcgccgaccgggcaggccaagggctggcggctgtggatcgagggctgggccgtggcgctgcgtgagcccgcgctgcgggaggtcacccaggatctcgaccggcagtggaaggccgcgatcacggaggtcatcgcggagggcgtggccgggggcgagttccgctgtccggaccccaccggcgccgcgctgcggctgaccgcgctgctggacgggctcgccgtacagatgacggcgtactcgggcgcggtgtcccgggcgcgcacgcaggagtgggtggacgacgcgctcgcgcgtgaactgggcctggagcgcgcggcgttgacggcggcgacacgctgagcggccctcaacgcaggcacgggcacggcccgggccgttcggcccgggccgtgcccggcgcacaccgcgtgcgagccgtcagacggccgccgcgatccgcatcttgatgtcgtccggcgacaggctccccttcgccgcgacatggtcgccggaggactccccgcgcagcctgcgcccgatccacggcaccaggtactcgcgtgcccagtggatgtcgtcgcgccgcacctcgaacgtgccgcggggcggcagcggcggccagggctggtccggatcggccgggatgtcgaggccgagcacctgacctgcccgcagcgcgacccgggtgtgcccctcgggcgacagatgcagccggtcgttgtcccaggcccgccggtcctggatggtcttgagggaccacaggtcgaggaccgggcagccgtaccggtcggcgatggcacgtacgtgcccgttgtacgtggcgatcttgccgcgcagatgcttcagcacgggcatggttcgggtgtcgaagccggtggtcaccaggacggtgcccacggcggcggtgaggtcggcgacggcgcgctcgaagcgctcggcgacctcgtcggggtcggtgccgggccggatgatgtcgttgccgcccgcgcagaaggagaccatgtccggcgcgagctccttggcccgctggagctggtcctcgacgatctggtcgagcagtttgccgcgtacggcgagattggtgtagttgaattcgccctcgggccgccggtccgcgagaagtaccgcgaaccggtcggcccaaccgacgaaggccccgtcaggaccggggtcgccgacgccctcggtgaagctgtcccccaccgccacgtacgacccgatcactgatctgttgtcactcttcgaatcgtctgccacatcggcccatgattcacctaccgctgtgagctacgcgaccgtaagaaggggttgacgtgtggtgagataagccactcataaagtatgggtcaacggcggaataacagcctctcaggcgtggttgtacagccgccacacccggaagcccgtgatccggaagtggctccatgtggtccggaacgcgaagtgcccgctcgtgtacggctccgggtcgctgtggtcgaagaccggccgcccgttgttccaccactggacggtggagccgtccgagacgatccggacgcggttcggctcgttcgccgtgagcagcggttgcgtgtagtcgtacagcagcggccggacgcccgcctcgccgacgtaacggcgcagccgcgtggtggtgttcgcgttggcgccgtacccgacgtagtacgtcttgaggtggtcgtactccgcgagcgcgccgccccgcggggtggcgaagaggtcgtccggggagcgtacgtcgacggcgttccagaagttgttgaggtcggagacccggtcgttggcgccccccgcatcgacgggtgtggccgtgtactcgatgacgtacgggccttccagccgcttcctgaaccagaccgtggcaccgctcggcacgtcgatctccaggacgccgcgggccgcggtgaccgtgccgccgtcctggagttcggtggcccaccggccgagtccgtgccggaagtcgtcgtgggcgatcagccggcccccgcggtggtgcggcgaggcgctcgcggccgtggcgggggcgagcgcggccagcgcggcaccggtggccagggctccgaaggctctacgtgtggtggtcatgggaagcggctccttcagtggtggtgagggcgggcttcggcactcgccgtgcacttctccgccttcggcgccgccggcacatcccacgtggtgtcggcgagggcccaggagaactgggcggtggcggccgcggctgcgactgcggcgcccttgatgacggtgcgtcggtcgacgcgggcacggggacctccgtaagcggcagaaagcgcttgcgcaggtcactctggtgccaccgacacccacctgtcgatgccttgcccgcgcgtgccacacgaccgcaatgcgccgatcatgaacccgccacggccatggggccggtcacgcatccgcggcgggcccggacagaccgaaggcccggacaccgaaaggacagaccgaaggccggacaaaccgaaggccggaccccgggatggggtccggcctcaggagcgaagcagccgggtcagccgggtcagccgacgacgacgccgtgcgcgcgcaggtaagcgaccgggtccacgtccgagccgtaggagggggtcgtacggatctcgaagtgcaggtgcggtcccgtgacattgccggtcgcaccagagaggcccagctgccggccctcggccacgctctgccccgtggagacggagagctgggacatgtgggcgtactgcgagtactggccatcggcgtgccggacgacgacctcgttgccgtacgcgccgccccagccggccgagacgacggtgcccgcggcgacggccttgatggtggtgccggtcgggaccacgaagtcgacgccggtgtggtacccgctggaccacatgctgcccgcggtcttgtaggcggtaccgatggtggcgccgtcgaccggcagggtgtagccggcgccggtggtggtgtccgcggcccgggtggccgtggtcgtcttcgacgcgggggtcttcgccgtggcggacttcacccccgtggccggcttcgtcgccgtggacgactgcgtggcggcgctcgacgcggacttggcgccgatcgtcagcttcagaccggggtggatcagcgtcgggtcgccgccgatggcggagcggttgtccgagtagagcttcttccagccgccggtgacgctctgctcgtcggcgatcttcgagagggagtcacccgcccgcaccgcatacgtcttcgtgccgctcttctcggcggccccctgcttcgcggcaacgggggctgcggagacctttccggagacggccgccgtcggggtggcggcgtgggcgccggtcgcccccatcagcggcagcgcgagcgcggcgccaccggttccggcgacggcgatcgagcgggtgaaacgcggggacctggggcggcggtgcttacccttcgcgggcatggtgcattcctctccgatgcctgcgaggtgagctgtcgggtgcgagctggagatgcccggccgcgcttgcgcgcgacttgacccctagcctgttccggagaccggaacaggcgttgttgcctgtgggtcccccgctcctgccgggcacgggtgagtgtgcgggttccgggcggcggcaggattcggcgttccgtccggattggtggcgaacgtagacgaagtccgcgcggagcgacaagcgttgggtttcccgagtgcccccatctcttgatccatgggcgaaatgcccgtcaccctgcgtcgacgcacggccttcccctttcccaaaccggctggaacaaaggagaattacgtgaacatgacgataacgcaccgtcacggatatgacgctgctcacgcatcttcagcccagcaggccccatttcagagcgagttcgaatgaagcctacatttgggacagaacgctcaaatgcgacgtagccgaacaaccgtcgcatcgaggtccccgtgcaaccccgtccgcagcccgtgatgcagcagtacggcacctcggtgcacttcgcccgtttcacggcattcataggtggctgccgggtcgaggccgcgcagccggagcggggcgaccggctcgccgtagtgctgggcctggagccaggcgaggacgacggcctcgtcgccgtggacgtactgcacggcgctcagcccgcccgtcgggggccgcagccggtagaggtccccgcgctgcacgacgggccggatctccttgtagagactcacccagtcccgtgcctcgacgagttcccgctcgctccactcggccagatcgccgccgaccccgagcactcccgccatggcgctgacgaaccggaggcgcagcgtgctgactcgcccgttgagctgtgtgttcgggctgtcggtgacccaggcggccatgacccgggcggggtggatctggctgaatccgtgctggatggcgagccggtcgagcgggtcggtgttgtcggaggtccacacctggtccgtacgcgccatgatgcccaggtcgatccggccgccaccgcccgagcaggactcgaaggcgacccccggatgcgcggcccgcagccggtccagcaggcggtacagggcgcgcacatgatcgacccagagccgctgcggatatgcctccccaggccagccggcgtccgtgaagcagcggttgaagtcccacttcacgtagtcgacgggggcgctggacagcagtccgtcgagctgctcccagaggcactgctggacgtcctcgcgcgcgaggttgaggaccagctggttgcggaattccgtcctggtccgccccggctggaactgcacccagtccgggtgcgcgcggtacagctcgctgtccgggttgaccatctcgggctcgacccagatgccgaactgcatgccgagcgcgtgcacgtagtcggcgagcggcttgagcccggccgggaagcggtcggggttgggcgtccagtcgccgagcccggcccggtcgccggtccgcgccccgaaccagccgtcgtcgaccacgaacagctcgacccccatcgccgcggcccgccgcgcgagagccccctgctgttcctcggagatgtcgaaggtggtggcctcccaggaattgaagagcaccggacggtcctggtccgcgtccgggatgacgtacgcccgctggtacgcgtgccaggcgcggctcgcgccgccgaagccgccgtcgctccacagccccgcgaagacgggcgtcgtgaacgactcccccggccccaggcgcagcaggcccgagtcgtcgtaccccgcgccgccggtgatctgcacgcgcgcgtcggagagttgggccaccgagatgcgccaggagccggaccagccgagcgcgcagccgtagacctcgccgctctcctcggtcgcctcgcaatcgagcgcgacccacggcagatgctggtgcccggtgtgcccgcgccggctgccgatgatcttctcgccgtaggtgaggtccgagcgtacgaggcgggactcggccgcccagcgcccgtgcagctgggacagccgccagccgtcgcgctcgggcagggtccaggtggcggagtcggcgcgcagcagctccagggcgggtccgtcgttggccagcgtcacccagcgctcgacgacgtcgtcccgcatccggtagtgcagcgtgacggccagccccgagtcgccgaaccgcagccgcagctcgtcgccttcggtctcgtacgcctcgaagcgccactcggtgccacggcgctcgtcggtgcgcacggacagcgccgggcgtacgaagcgggggccgccctcgaccgggtactcctcacgcccgtccagcggcgattcgaaggacgagccgcccggggcggggagggcggcgagggcctcggcgtcggcgagggcgatccgcgggccccagtgcagatgcagcagttcgtgaccctcggtgagatgcacggcgtagctgctcgtgggccccgaaagaagccacgtacgtcggtcttcggcgatctcaaccatcaggcccccacagatgtcaacagatgtactcaagcatcaacatcatcaagggatccgggcctcgggggcaacgcctgtggacaactcattgcctcaggaacccatgtcgtatcgtcgggaaagcgcccgccgacgagccgcttcgacggggccgaacaggaggagccctcgtgacgcagcaggtcccgtccaccgagcccgagctggccggagtgcgcaacttccgcgatgtgggcggtctgccgaccgtggacggccggcgagtgcggcacgggctgctgtaccgcagcggccatctcgcgcacgccacggacgaggacgcggcgttcctcgcctccctcgacctgcacacgatcttcgacttccgcaacgccgcggacatcggcctcgaagggccggacgtcgagctgccgggcgtgcgcaatctgaacttcccgctgacggacccggcgcacggcgcggaattctggacgatggtccgtgacggtgatctggaccagctacgcggcctcctggcggacggcaaggccgcgaaccggatgatcacctcctaccgcacgatcatcaaggagcgcacggccgagcacgggcgcgtgctgcgcgagctcgccgaggagagcgtgcccgcgctgatgcactgtgcggcgggcaaggaccgggcgggcctgtcgatagctgtcgcgctcctggccgtgggcgtggagcgcgatgccatcgtcgccgactacctggagtcgaacgccccgcaccgccgctacaaggtgcggcgctccagcagcgcggcccaggcgtacagccccgaggtgatggagctgctcagcccgctcttcgaggcgcgggccgagtacctggcggcggccttcgagacgatcgaggagacctggggcgacaccgacacatatctggagcgggggctgaagatcacgcccgagctgcgggagcggctgcgcgagcggctcctcgactgagaccgccccctgggcgcgcggccggctacttcgcgcccagctcgaacagcaggtagatgaagcccgcgaagaggtgaccgaccgcgatgtagatgatgagccggacccacagcgcgcgcgggaacttctcctccatggacctgcggttctggctggactcgggctgttctgtcatggtgtgtctcccatcgtcgggtgtcccgtcgccgggccgaggcacagcgtggcggcggggctctgcagcagggtgtgaaggaagagcagctcggccccgtcgtggtcggctgccgcgaggcggtgcggggtcagcgagtcgaagtgcgcgctgtcgcccggcccgagcagatgtgtggtgtcgccgaggcgcagccgcagccgccccttcaggacgtacagccactcctcaccggggtggacgcgcacgacatcgccctgggtgccgtacggcacgtgcacgcgcagcgcctgcatggcgcgaccgcccgcgcccgcctgccagtacgtccagccacccgctccggccggctccatgtcggcggcgcgcacgacggcgtcccggtcgcctacggtctcgcccagcagctcggagacggtcgtaccgtagatacgagcgagtgcgagcagcatcggcagcgagggctggcgctgacctgtctccagccgggagagatgggccggcgagagcccggcggcgcgggccgcgacctccagcgtcagggaggcgcggcggcgcagcgcgcggagctgtggtgcgacggcgggcaggtcctcgaccggcccggactcggaggaactcatacctccattgagccggagttttgcctgtgggacaaatcttttgccccacaggcaaaatccctgacggctaccgcttcacgtcggcgtctacctctgggcaacagcctgcttgaccagcgtcttcccgaagtcccacagcaggccgccgccgctgtgcgcgtcgtccatcacggcggtgaaggcggccacgaaccggtccacgtcccgctcgtcgatgatcagcggcggaatcagcttgatcacctccaggtggtcgccggagacctgggtgaggatccggtggcgttgcagcagcgggacgacgaccatctgcgcgaacagacccttccgggcggcctgcagcacggtccagcggctgcgcagcttcagcgacgtgggccgcccgaactcgatgccgatcatcagaccccggccccgtacgtcactgagcagctcgtacgtgtcgacgagcgccgcgagccgggacttgagctgttctccggtcgcgcgggcgttcgcgacgatctgctcgttctccatgacggagagcacggcgaggcccgccgccatggcctgcgcgttggagccgaagctcgccgagtggacaaggacgcggtccatcgacgaatagaccttcttgaagatccattccttgcccagggtggcgccgaccggcacatagccgcccgacagcgccttggccacacagaccaggtcgggctccacgccctcctcgtgctggtaggcgtagaagtcgccggtgcgcccgaggccggtctgcacctcgtcggcgatgagcagcgccttgtgcctctgcagcaggtcctgggcggcgcgcagatgtccgggcggggcctcgtggacgcccttgccctggatcggttcgacgatcagggcggcgacgtcgcccttcttcagctccctcgccagggcgtcgagatcgccgagtgggacggcggtgtcgggcagcagcggggcgaagccgtcgcggaagccgtcctcgccgttcacggacagcgagccggtggtcagcccgtggaaggcgtgcgagcagtacaggatccgcggcttcccggtggcgtaccgggcgaacttcagcgcggtctcgaccgcctccgtgccgctgttgccgaagaacacgcggtcgaggtgcgggctgtgcgtgagcagcttctccgccagcagtccgggcagtggctggcagtcgaagcgggtgaggtcggcgagcgaggcgtccaggacgtcgtgcagcgccttgcggacgacggggtgatggcggcccaggcccatcaccccgaacccggcgagcatgtccaggtagtccttgccgtccgcgtcccagaagtgcgccccttcggcccgctcgtacaccttgtcgaagccgatggtgtgcagcatgcgcgggagctggtgattgaggtacttggcgtgcagttcgtagcgctcggcgccgcgctcggccagcagggcgccgaggtcgaactcccggtttccggaaggggccccctccgacggcgccttccctgaggggatggtcattcctgtttctccttggacagctcttccttggtggccagccccgcgctgatccgcccggcgatctcgacgggcgtcaggcctatgtcggccagcacctcggcgcgcttggcgtgcgcgaggaactgctccgggataccgaaccgccgtaccggcacgtcgacttcggcgtccgagagggccagcgcgaccgcggcgccgacgccggccgcccggctgttgtcctcgacgaccgcgaccagccggtgctcggcggccagccccggcagcgaagggtcgacgggcttgacccagcgcgggtcgacgaccgtgcagccgatgccccgcgcctcgagcagttcggcggcctggaggcagaccggggccatgacaccgacggcgaccagcaggacctgcggagactcgggaaagcggtgcagtacgtccatgccgcccacatggtcgaccgccgggatcgcgggccccacggactccttcgggaaacgcagcagcgtcggcgcgtcgtcgaccgccaccgcctcccgcagctgggcccgcagctggtcggcgtcgcgcggtgcggcgatcctgaggccgggcaccacctggaggatcgacatgtcccacatgccgttgtgggaggcgccgtcgacgccggtgaccccggcccggtccagcacgaaggtcaccccgcagcggtgcagcgcgacatccatcaacagctggtcgaaggcgcggttgaggaaggtcgcgtacaccgctacgaccggatgcagcccgcccgtggcgagacctgccgccgacaccgccgcgtgctgctcggcgatcccgacgtcccagacccggccggggaacttctccgcgaacttgttcagccccaccgggtgcagcatggccgccgtgatcgccacgacgtcctcgcgctcctcgccgatccggacgatctcgtcaccgaacaccgaggtccaggaagggccgttggagggggcgaggggctcgcaggtgagggggtccatcacgccgacggtgtggaaacggtcctcgtcgtgggcgagcgcgggctcgtatccccggcccttctccgtcaggcagtggatgagcaccggcccgtggaaacgtttcgcgcgtctgaacgccgattccatcgccttcatgtcgtgcccgtcgatcggccctacgtacttcagccccaggtcctcgaacatgccctgcggcgcgaacgcgtccttgaaccccttcttcgcgccgtgcagcgactcgtagagggtgttgccgacgaccggcgtgcgcagcagtacgtccttgccccaggccagcaccttctcgtagctgtcggtggtgcggagcgtggcgaggtggttggcgaggccgccgatggtgggcgagtacgaacgttcgttgtcgttgacgacgatgatcagcgggcggtccttggcggcggcgatgttgttcagcgcctcccaggccatgccgccggtcagcgcgccgtcgcctatgaccgcgacgacatgccccttctcgccctgcacctggcgggccttggcgagcccgtccgcccagccgagcacggtcgacgcgtggctgttctcgatgacgtcgtgctcggactcctcgcgcgagggatagccggacaggccgcccttgctgcgcagcttggaaaagtcctgccgcccagtcagaagcttgtgcacatagctctggtggccggtgtcccacaggatgcggtcgaccggtgactcgaaggcccggtgcagtgcgacggagagttccaccacccccagattgggccccagatggcctcctgtcctggcgaccgcatgcaccaggaactcccgtatctcttcggccagttcaccgagttccgcctcggacagcgccttcaggtcgcgtggtccccggatgttctccagcatcgtcacgtcgggccccctctcggtccgtagctgctcaactcacggtgacggccggttccccggacgcgacgccgttctgctccatctgctcggcgatcttcatcgcctcctcgatcagggtctccacgatcttcgactcgggcaccgtcttgatgacctcgcccttcacgaagatctgtcccttgccgttgccggaggcgacgccgaggtcggcctcgcgggcctcccccggcccgttgacgacgcagcccatgaccgcgacgcgcaggggcacctccatgccctccagacccgccgtgacctcctcggccagcttgtagacgtcgacctgggcgcgcccgcaggacgggcaggagacgatctccaggcgccgctgcctgaggcccagcgactccaggatctggatgccgaccttgatctcctcgacggggggcgcgctcagcgagacgcggatcgtgtcgccgatgccctcgctgagcagcgcgccgaaggcgacggccgacttgatcgtgccctggaaggcggggccggcctcggtcacgccgaggtgcagcgggtagtcgcactgcgccgccagctggcggtacgcgttgaccatgaccaccgggtcgttgtgcttgaccgagatcttgatgtcccggaagtcgtgctcctcgaagagcgacgcctcccacagcgccgactcgacgagcgcctcgggggtggccttgccgtacttctccagcagccgccggtcgagcgagcccgcgttgacgccgatgcggatcggcgtgccgtgctccttggcggcgcgcgcgatctccttgaccttgtcgtcgaactgcttgatgttgcccgggttcacccggaccgccgcgcagcccgcctcgatcgccgcgaacacgtacttcggctggaagtggatgtccgcgacgacggggatctgcgacttgcgggcgatgaccgcgagggcgtccgcgtcgtcctgcgtggggcaggcgacgcggacgatctggcagccggacgcggtgagttccgcgatctgctggagcgtggcgccgatgtccgacgtacgcgtcgtcgtcatcgactgcaccgacaccggggccgtgccgccgaccgccagcggtccgacctggatctgccgggagacacggcgttcggcgatcggacggacgggcacttcggggacgcccagggaaatggccgtcatgacgtcacccgcggtttccggagacggtctcgcgggccgcgcgcagggactccttgagggaacccatcgtggccaggacggcggtcggctcgtagccgcagtgcgccatgcagttggcgcagcgcgggtccttgccgcgaccgtacgcgtcccagtcggtgtcctcgatgagctcccggtacgtcgtgacgtacccgtcgctcatcagatagcagggcttctgccagccgaacagcgagtagttggggatcgcccacgccgtgcacgggaagtcgaccttgccctcgaggaagtcgaggaacagcggcgagtggttgagccgccagcgccgccggttgccgcccgcgaacgccttcctgaacagctcgcgggtctgctccacgccgagaaaatgctcctggtcgggcgccttctcgtaggcgtaggcgggcgagatcatcatctcgtccacctcgaggtcgtcattgaggaagttgagcacctcgatgatcgtctggggggtgtcggtattgaagaaggtcgagttggtggtcacccggaagccgcgcctcttggcctccttgatggcctccaccgcctcgtcgaacacgccttccttcgcgaccgactcgtcgtgccgctcacgcaggccgtcgatgtgcacggcgaacgcgaagtagggcgacggggtgaagtcgaccatcttcttgcgcagcagcatggcgttggtgcacaggaagacgtacttcttcctggccaccagctgccgcacgatctcgtcgatctgggggtgcatcagcggctcgccgccggcgatggacaccatcggcgcaccggattccagcaccgcaccgacggcctgcgccaccggcatgcgctgcttgagcactccggccgggtgctggatcttgccgcagccctcgcacttcagattgcaggcgaagagcggttccagctccacgatcagcggaaacttctcccgcttgcggagcttctgttcagcgagatacgtcgcgaccttgatggtctggcgcagtggcatggccatctggctcacctccgggggagcagcaaagaacggtgccattcgaagaaagcgggaagtacggcacggagaacgcggaaggctgatattccaccgcggaccgtgccgatacggacgagttcatgttctggagcgtccacgaccactcggacggccgcaaccgggcgcgtgcccgtgcacacggcgccgtggagcgtggacgcggattccatgtcggccgcgattgcgccggtcaggagcagatccgaccgttcgtgaccgcggacgacgtgatcggagccgatgagcggccccgtgtggacggtgcgcccgggcacggcgcggacgagttccttgaccagcacctcggtgcccacgcacggggtgactccacgcgggtcccgggtctcctcggcgacgacgagatcacccgggtgcataccgggagcgagccccgcgcagaagcccgtggccacgacggcggcctcacgcagcgccgggtcggcgagcacccgggtgaccgcccgctcggcggccttgggccccatgcccgtacgcagcaccgtgacgggcccgtcggcaccgccgcggtcgccgctgcgcagcgccaggcgctcgatgccgagcgcgcacgcgatgagcagcggggccggatcgggcttcgtgctcatcaaccccccttgacctcgacgagcggctcgccgttgacgtaccggccgagcgcggtgagcgggaagacctggcggtagaggtggtagttgatcgagaagtcccaggggaacccggtgccggtgaagtacggctcgtcccaggagccgtccggccgctgggtctgggcgagccattcgatcccgcgctccaccgctttggactcgcgctcccccgccgcgagcagtgcgagcagcgcccaccccgtctgggaggcggtggaggcgcctttgccgctccactcggcggcctcggggtaggagcgcaggtcctcgccccagccgccgtcgtcgttctgcacggtctccagccaggtgacggcacggcggatcgcggggtgcgaggcggggagtccggcggcgaccagcgcggggaccaccgacccggtcccgtacacgtagttgacgccccagcgcccgaaccaggagccgttggcctcctgcgcggagagcagccactggatgccgcggcgggtgcgcgggtcgtgcgacaggccctcgaacgccagcatctccacgacgtgcgcggtgacgtcggcggacggcgggtcgatgacctcgccgaagtcgcagaacggcagccggttgggaaacgggctggtgttgtcgacgtcgaaggcgccccagccgccgtccttggactgcatgccgaggttccagcgcaccccgcgccggatcgcgttgtccaggcgctcggggtcgtggtgcttgacgcgacgcagcgcgaggacgacttcggcggtgtcgtcgatgtcggggtagttgtcgttgtggaactcgaacgcccagccacccggcggcagttggggacgtttcaccgcccagtcgccgggccggacgatctcctcgccgagcatccagtccgccgcccgcacgagctgcggatggtcggcgggcacgcccgcgtcggcgagcgcgatggtcgcgaggcaggtgtcccacacgggcgactggcaggcctcgatcatccgcgccccgtcgtcgcgccacacggcgaaccggtccagtgacgccagcccctcgcgcatcacggggtgttcgaggtcgtagccgagcagatacagggcgatgaccgagtacacggcgggcggctggataccaccccagcagccgtcgttctcctgccgctcgatgatccagcgcgcggccgtgttcatcgcggccttgcgcagcctgcgcggcgcgaccttgcggtacgtgtgcagagcgacgtcgagccgctggaataatccgtcccaactcaccatcggggcaaggggcttggccgggttggggtcattcgcgtcggcgtgcagttcatcgagcgggaacggggcgggccgcaccggacgcttcgccgagacgacggtgagcggcacgatggtctgccgcgcccagcagccgaagtcgtagatgttgagcggcatccacttcgggaagtagatgagttccggcgggagttcgggcaggtcgtcccacttccaccagccgaacagggcgagccagatccgggtgaagacgcgggccgaggcgatgccgccccgctcgcggatccaggcggacgccttcgccatgtgcggctcgtccgggccgtcaccggccaggcgcagggcgacatacgcctcgatggtggcggagaggtcaccggggccgccgtagaaagtggcccaggtgccgtccgcacgctgctcgcccctgatgaacagtccggcggctcgtgtggtcttctcgtcctggattcccaggaactgacggagcagcaggtcctcggcgtccatcgtgacgttcgtctcgaggtcgcccttccaccagccctcggcgtcctgccgcgagagcaggaagtcggtggcgcgctgtgtggcgcgcgcggcggcgtcttggattccgacactcccggccgcctgcgggatcgtgtcgtgtggttcgctggccgaggcagcgcggggcggcagggccccggtgcttccgtcggtcgtcgctgtcatggcttccccttcgtgcagtggtacgactctgctgtgggtccgccgtcggccagtgcttctctctgctcgcggcaccggccggcgactacgcgaggtttattcgaccgatagtgatcatctcttccgtacgacgacgaagtcggcgagcgccacgagctgggcccgcacctgctggggcatctcgatcgtgtccagggcctcgatggcgatcgtgtgctggcgccgcgcctcctgggcggtccactcgcgaccgcccgcctcctcgatgagcgcggcacgcgcggcgaactcctcttcggagaagttctcgaagtcgctgctcttggcgtcctcggcgagcagttcgccgagccgccgggaggcgggtccgcccgcggcgagcgccgccacgaccgggagggacttcttgcgctggcgcaggtcgctccaggtctgcttgccggtggactccgggtcgccccagatgccgaggaggtcgtcgacggcctggaaggcgaggccgaggtggtagccgtacttctccagggtgtcggcggtgcggtcgtccgcgccgccgaggaccgcgccgatggagcaggcgcaggcgagcagcgcgccggtcttgttgccctccatctccaggcactcctcgacggtgacccgctcgcggtgctcgtaggagatgtcctgcgcctggccgtcgatcagggcgcggctggcggtggtgaggcggcgggtggcgcggcccgcctcgaccgtgccgagctccaggaggatctcgttggccagcgcgaagagggcgtcgccgacgaggatggcctgggcggggccgtgcaccttccagacggtgtcgcggtggcggcgctgttcgtcgccgtccatcaggtcgtcgtgcagcagcgagaagttgtgcaccagttcgacggcgaccgcgcccgggacgcccacctcgggggcggcaccggcggcctgcgcggagagcacggcgagggcggggcgtacggccttgccgccgtcaccgtccgcggggttgcccgcggcgtcgatccagccgaagtggtaggcggcgacggtgtccatgggcggtgccaggcggtccacggccgcgcgcagcaccggggtggacagggtccggccgcgctccaggagcgcggtcacgtccaccgcgtcggcagccttctcggccgggggcacagtgggcacagtctctcctcttgttgcggtacggggggtgcggggaccagtcccgtgcagatcgggcgtcacgccgcctcctcgaagagttcgaggaggtgatctcggggccggcccagggcgttcagggcggcgcccgccgcactgacaccgctgcggaccgcactctccatggtcgcgggccaccctgtggcggtccacgcgccggccagacagaggccgggtgccttggtgcgggcgccgggccgcagccgcccgacgccgggggtgggggcgaacgtcgccgtgcgctcccgggtcacgaagaagtccttcacctgcgcgccgcgcgtcgcgggcaacagccgctccagctccggcagatagcgctcacgcagcacggagacgggctcgtcgatctcgtcctgcgcggccgactgggagagcgccaggtactgcccctcgggcagcccggaggcctcggtgcggtcgaagacccactgcaccggagagccgagcgccgcgaagaacgggcggctgagcaccttccggtcgtagacgacatggacgttgaggatcggcgcggtgccgatctccagcagccgctcgggggcgtcgagcgcgccttcgggcagcagttcgtgggcctcgcgctggggtacggcgaggacgaccgcgtccgcgtgcagcgtctcgccgggaacctgaacgctccaacgcccgtttccgttgagggagatggaggtcacgcgtgtacggacttcggtacggacgcccacggagtcgagcgccttgcgggccagccggtcgtgcagttcgcccagcgggacgcgcgcccagccgatgtcggcggcgcccgggtcggacagcagaccggtcttgaacaccatcgcggcgagcccgagcgaggaatcgccggccaccgcgttgagggtggcgaccccgaccaggtcccacagtgcctcgacggcacgcgccgactgaccgtgcgcggccagccagctgccgaagttctgcgtgtccagcgccggatccgcgaggtcgagtcccttgagcgccagtgcggcgcgcccgactctggcgcgctcggcgagcgagagatgcggataggtggcgaggctcttcgcgagatgcagcggcaccggcagcgcggtgcggccgattctgccgagccgccgtcccggcttgcccccggcatcgagaacgggcacgtcgagacgatcctgcaagggggccagcgaggcggcgtcgatgcggtcgaggaaccagcggtacgccgtgcagcagcgcagatagacgtgctggccgttgtcgacggtcagggcgccgcgctggaaggagaaggcgagcccgccgaggcgtggccttccctccagcagcgtcacacgcactccggcgtcggcgagggcgagcgccgcggtgatgccggcgagtcctccgccgaccaccacggccgccctctcggggcggccggaggcctccgcgtccggcccctcgagccgagtggcgtcgctcatcgcgcatcctcccctgccggtccgccgcggtgcttgaacggtgcacggcaggccgttgcagtcagggacgcggtgcaccaccggagggttgcgtgccgcttttcgccgctggaatcaccttggcccacattgtccatcagacgcgcctcctgacggtgcgccgggacacatgccgggcgtcgaggcccgacaggccacgcacggcgacgtacgccttctcgcgtccgggcagcgagacccggccgcgcagtacggcctccggctcgcgctcgatgcgatcgaggagccggcggtagatgcccgccatcgcggcgacacaggcaccgctgcgccggtccagcatgggcagcagccggtagccctcggcgaaaagggcgcgggcccgacgcacttcgaagtgcacgaggcccgcgaagtcggatccctccggtgggatcggccggtcgaacccggccgagcagccgaatttggcgaggtcgtcggcgggcagataggtgcggccgccctcggcgtcctcgcgtacgtcgcggaggatgttggtgagctggagagcgaggccgagggtgtcggcgtactctgacgcgcgctcggcgccgcgggcgcccggttccgtgccgaacacgccgagcgagacgcggccgatggcccctgccacacagcggcagtagaccttgaggtcgtcccaggtctcgtaggtctcgccgcgcacgtccatgaggacgccgtcgatcagttcgtcgaggccgccgagcgggatcgggaactgctcggcggcgtgcgccagggcgaccgcgacggggtccgtgtcgtcctcgtccacccgcccgtcacgcacccgggacagcagcgcccgggtgtcctcgagcctcgccgccttcacgtcgggcgcgagcgcgccgtcgccgatgtcgtcgacgcgccgcgagaaggcgtagaccgccgacatcgcgcggcgcttgggcgtcggcagcagcctgatgccgtaggcgaagttgcgggcctgctgcccggtgacggtctcgcagtagctgtatgcggcgagtaccggtgcggacacgtgttgttccgactccacggtccggatcacccctctcctcgcagagtcacgcccacctcgcgcagcagctgaagcttgccgggcttgggcgggccgggaagtacgtcgtattcggcggcggcgatcgcgcggatcgccgcccttccccccgccacgaaccccgcgagcagcagcctcagcctgccgtggacgctacccacgagaggggtgccttcattcaggaggttcagggcgcgttccgtttcgtatgcgaccagggcgcgcaccgatgcgcctgctgtggccgtggcaagatccgcctcttgcacatggaagcgcttcatgtcctcggcgggcagatagacgcggtcacggcccaggtcctcggagacgtcctggaggtgctcgacgatctggagcgccgtgcagatcgcgtcggagcggcggacgcgctcgggggtggaggtgccggtgacaccgaggacgaggtggccgaccgggttggcggacagctcgcagtaggcgaccaggtcgtcgtaggtctcgtaccgcgtgacgagctggtcctggcggttggcggcgatcaggccgaggaagggctcggggctgagaccggtgcgccggaccgtgggctggagcctgcggagcagggggtggcgcggggtggagtcgaacacccggtggaggtcggcctcgaaggcgtccaggagggccagccggtcctcggcctcccgcggggacacaccgagcaggcgggcgtcggcaccgccgggggccaggtcgccgtcgccgatgtcgtcgacgaggcgggcgaagccgtacacggccatcaggtcggtgcgccaggccctgggcaggaagaacggcgccacggggaagttctcgtccgcggccttgtcgagggtgtcgcgctccgggtccgcggcgcgcgccgtcccggcttcggtcactgctcgccacccggcgcggggacggcacatgcctcgcggcgctggagaccttccgtagccattgccgtcacatctcccgttctacactgccgacccaatacatcctatttcggacacgccgcccggttcgtcgcacagcgtgaccggtgtgggggtgtcgcgcgttatcgccccacttgccgcgaatcagcaccggtacagcttacgttgtacaacgcgccatgctccgtcggggtgtcctgcgcatcacaacaacacaccgattggcgtcaagattcctacggacagccagagttggcgcttcctttgcagacgcagggccccgccgaagcgttccggcggggccctggactcttcgagctacttgcccgtgaacttctcgtactccttgagaacctcttcggtcgggccgtccatgcggagctcgccgcgttccagccagagcacgcggtcacaggtgtcgcggatcgacttgttgttgtgactgaccagaaacaccgttccggcctccttgcgcagctcgcggatgcgggcctcggagcgcttctggaacttccggtcgccggtggcgagggcctcgtcgatcatcaggacgtcgtggtccttggcggccgcgatggagaagcgcaggcgcgccgccatgccggacgaatacgtccgcatcgggagcgtgatgaagtcgcccttctcgttgatgcccgagaagtcgacgatctcctggtagcgctccctgatctgctctcgggacatgcccatggcgaggccgcccaatatgacgttccgctcgcccgtcaggtcgttcatcagcgcggcgttcacgccgagcagcgagggctggccgtccgtgtagaccttgcccttctccgcgggcagcaggccggcgatggcccgcagcagggtggacttgccggagccgttggagccgatcaggccgatggcctcgccccggtaggcggtgaaggagacgcccttgacggcgtgcaccttgcgcaccccgcgctcctcgccgcgcttgacgatgcggctgagggcggcggtggcgctgcccttgccggtcttggcaccgttgacgcggtagacgatgtgcagctcgtccgcgatgacggtgggaatgtgggagtcgttccgctgctcagccacggccgtaccgctcctccgccttccagaagtacacgaagccgccgagcgccacgaggacggcccagccggcggcgaccgcccagacgtgcgggggcaggttctcggagccgtacccgtcgatgagcgcgaagcgcatcaggtccatgtagatggcggcggggttccactgaaggacgtcggcgacccaggccggcttgtcggccagcatgaccgggatcgagaacatcacgccggacgcgtacatccacgtacgcatcacgaacggcatcagctgggcgaggtccggggtcttggcccccatcctggccatgatcagcgcgaggccggtgttgaagaggaactgaagcgcgaggaccggcacgatcagcacccacgaaaggctcgggtagctgccgaacccgatcgcgacgaggaacagcacgatcatcgagaagagcagctgctggagctgctggagcgagaacgagatcggcagcgcggcgcgcgggaagtgcagggcgcgcaccaggccgaggttcccggagatcgcgcgtacgcccgccatcaccgagctctgcgtgaacgtgaagacgaagacgccggtgaccaggaacgggatgtacacatcggacggcatgcccttgctggcgtgcaggatcagaccgaagatcaggtagtacacggccgcgttcagcagcggggtcgccacctgccacagctggcccagcttggcctggctgtactgggcggtgagcttcgcctgcgagaaggccaggatgaagtgacgccgccccaggagctggcggacgtactcgacgagcccgggccgggcaccgctgaccgcgagcccgtacttggcggccagctcggccccggagagcccttcgtcgggcgacggccgggcgctcaccgcgacaccgccgtcatgcgttgtctcactcacaagtggatgctttcgtcctcaaagtgcgcagccttgtcggacctaggcgggagccagggaccggggtacggccgaatgctctcagatatcgagcttgtcagatgacgggaggtcggcccagtcgggtcaggcgccacaccgtacgccacttcatcgggcgccggggtccgcacgggctggtccagccctccttgaagccgccgaaccatgccttgagggcggggcccgaggggcggcgggccagcgtcaggagcagccagacgcccaggtagaccgggacgaggggggcgggcaggttgcggcgggccagccagacgcggttgcgggccaccatgcggtggtagaccgcatgccgcgacggggcggtcgtggggtggtacagcaccatgtcggaccggtagtcgatcatccagcccgcgtcgagggcccgccaggccaggtcggtctcctcatgggcgtagaagaactcgtccgggagcccgccgacctcggcgagcaccttcgtacggacggcgttggcgccgccgaggaaggtggtgacgcgtgagctgcgcatcgggtcggaggcgcgcagccgcggcacgtggcgacgctgggtctcaccggtgtcggggtcggcgatgcggaagctgatgatgccgagttccgggtcggccgtgaaggcctggcggcacagttcggcggtgtcgtggtgggcgagcaggccgtcgtcgtccaggaagaggaggatgtccacgtcggtgccgccggggccgaaggcctcgatcccgacgttgcggccgccggggatgccgaggttctcgggcagctcgacggtccggacgcccgcggggacgtccgggacgggagagccgttgccgaccacgaccacctcgacgcggtcgccgtcctgcttggcgaccgagtcgaggagggcacggagttcgtcggggcggttgcccatcgtgatgatgaccgcgccgacctttgtggcggtgctcacttcagcctgctcgacgcgaggatggacacgaggtgcagcagggtctggagcagggcgatgcccgccaggaccgctacgccgaggcgcgagaagtacaggtcgccccggatcgagtccaggatcgccaggaccaggatcagcagggacgcctcgaccccgaggacgagccggtggaacttcaacgcggcggcggccttgcgggccagcgccatgccggacgagcgcggctcggaggccgcctccttgaccggcggcaggccgccctggtgacgggcgacaccgacaagatcggtctcggccttgatcaggatggcgccgagagcggcgagggtgccgaggaaggcccacagccagtcgatccggcccgagccccacaggtcggcggcgcgcaggccgaaaccgaccaggaccgcggcgtcgcacaggtaggcgccgacccggtccaggtacaccccgcccagcgagaactgctgcttccagcgggcgacctcgccgtcgacgcagtcgagcagcaggtagagctgaaccatcaccacgccgagcacggcgcccgtgatccccggcaccagcagggccggggcggcgaggacgccggcgacggtcatcacgtaggtcagctggttgggcgttatccgcgtgttcaccaggtgccggtcgatgcgcagcgagagctcgcgcatgtagagccggccggcccagtgttcgccgctccgccggtccttcacacccggagggtgaacgaccgggcggagctcagctaccgatggcttttgcatagtcggcgtatgcgtccctgatctgttcggtgttcaggtcgaggtgttcgaggatcgtgtagcggcccggcctggtctgcggagcgaactccacgacctggacgaactcgtccacggtgaagccgatctcgtccggcagcacggggaggccgtggcggtgcaggacctcggccatgtaccccgactcctcgtgcgcgccgcgcagatgcatcgcgaaggccgcgcccatgccgcactgctcgccgtggctcgccgcgcgcttggggaagaggaggtcgaaggcgtggttgatctcgtggcaggcgccggaggcggggcgggagtcgcccgcgaccgacatggagatgccggtgaggaccaggccctcggcgagcacctggaggaagctgtcgtcgccgacgccgcccgggtgccgcagcacggcctcgccggcctggcgggccatcgcggcggccaggccgtcgatctgctcgcccttctcccggtgggccagctcccagtccctgaccgccgagatgttggacagcgcgtcgccgatgccggagcgcacgaagcggaccggtgcctcacggatgacgtcgaggtcgatgacgaccgcgatcgggttcggcacaccgtaggagccgcggcccgcgtcgttgtcgagggtcgcgaccggcgagcacagaccgtcgtgcgagaggttcgtggcgacggcgaccagcgggaggccgatacgtgccgcggcgaacttcgcgcagtcgatgatcttgccgccgcccagacccacgaccgcgtcgtagtgcccggacttcatgtcgtccgcgagcttgatcgcgtcgtccagggtgccgccgccgacctcgtaccaggtcgcgcccggcagcgccggggcgagccgctcgcgcagcttggccccggagccgccgctgatcgcgacggcgagcttgccggagtgcgagatgcgctggtcggcgaggacactcgccaggtcgtccagggcgcccggacggatgtcgacgacgaccggcgaggggatgagcctcgtcagtactggcacgcgatttcacgtcccttggcgaggtcctcgtggttgtcgatctcgacccacttgacgtcgccgatgggcgcgacgtcgatgcggaagccgcggttgacgagctcctggtagccgtgctcgtagaactgctgcgggtccgtctcgaagaccgtcttcagggcgtcggcgagctcgtcggccgcctcgccctcgatgagggtgacgccgatgtactcaccggtcgcctcggccgggtccatcagcttggtgatcttcgtcatgccgccctcggggccgacgacgaccttcatctcctcgtcggcgagggacttcaccgtgtcgagggcgaggatgatcttcttgccgtcgccgcgggcggcgaggagggtcttctcgacggagaccgggtgcacggtgtcgccgttggcgaggatcaccgagtgcttgatggcgtcacggccgcaccacagggagtaggcgttgttccactcctcggccttgtcgttgtcgatgagggtgatcttgagcccgtacttggcctccagcgcctcgcggcgctcgtagacggcctccttgcggtatccgacgatgaccgcgacctcggtcaggccgatctccgcgaagttgccgagggtgaggtccaggaccgtgaggctgtcctcgttgccctcggggccaaccggcaccagagccttgggcagggtgtcggtgtaggggcgcagacgccgtccggcgccggccgccagcacgaggccgatcatgcgggttctccttcatcgtgtacggcgggtgcttgggaggacacccagaagcggatgctctcgacgagcaccacgagtgccacggccacggcgagtgccgtgagcgcgaccttgaaatctgtggggacgagcagcgcggccagaacggtgaccagcagcgtcctgccttcgtgccccccgatcgcacgcaccagccagtgcggcggcgcgccggcgttcccgcggatgcggtacaccgtgtcgtagtgatggtaggcgaccgcggccaccagtccgaaagcagccggcagcgctccgttcacgtccgctttggcggccagtaccagaacagtgccgtattcagccgcacggtagaacggcggaaccagccagtccagcgcgcccttgaggggcttcagcagggccacgggcgacaggagtacgtacgtcacggcggccaggacgggccaccagctgccgtacggggcgagagcggcggccagcaccacgagagcgcccgtgacaagagccacgcaggcgggaccgcgaaggcgcagcctgcgcgcgaagcgcgtcaggaactcggcgagcggcccggagtccgtcaggtcggcgagagcctgggccgcgcggtccgtccgccgcgccttgcgcgtcagtgaccgcagcacccggcccgccgtggtgtacgtcgccgcgaaggcgcacccgatgagcagcgcgtagaaggtgatgcggggagtcgtcagtgccgtgaggacggcgatcatcgcccagcgctcaccgatcggcaggacgatcatgcggcgcagccacaccgtccagccgacgctgtcgagcttgtccgagagggcggcggtggggctggtgttggcggtggcgtcgtggttcgcctcgttgaaggagaagtcgacgatgtggcggcagctctgcaggaccatcgcgccgagggcgagcgcccatacgtcgtcgccgccacgggccgcgccgagggcgaggcccgcgtagtaggcgtactccttggcccggtcgaaggtcgcgtcgagccaggcgccgagcgtcgagtactgcagggagtaacgggcgagctgcccgtcggcgcagtcgaggacgaaggagaacaggagcagcaggccggccgcgacgaacccggcgcgggtgccggtggccgcgcagcccgccgcgaccagggcggtgagcagggacgcggtggtgacctggttgggggtcagaccgcggcgggcgcaccagcgggccaggtagcgcgagtacgggctgatgaagtgggtggtgaagaagccgtcccgggacttcacggcggtacgcagccgtaccgcctcgtcgtcgacggccgtgacggcctggcggacctcgttgcgggcctgcgggtcggcggggacggcggcgacgagtgtgccgaggtcggggcggtgcacctggacgccgtcggcgtcgagggccgcggtgatgcgctcggcgaggttgtccatgacgacggtggcaccgccggtcgccgcggagctctcccgggccagggcgcgggtcagcgcctgccgggcgccgggctgggccgatacggcgccggccagcgcggcggcctcgaaacgcgggtcggtgagaccgaggcgcagcgcgtggaggtggcccacgaagcgggcgtcgacgatcgcgacccgctggttcgccggcacggcggcgaggagcgtctctgcgtcaccggcgtcggaggcgacccgcacgtcgaagccgagcgaccgcagatcgccttcgagcgacgatccggggaccggctgaccggtgaggatggcggtcgacagacgaactcactccctgggtgttgacgcgtgctcgcgccgggcgtgtgcgtgatggggggcacccctggccgtcgaaggcggccgggcggcgtgtcggcagaggctatcggatgatgagaagcgggcgttcaccggccgttcacggcccgatcaacccggtctggtcgaccgcctccgccgcgatcatcatcggggatttctgggccgggccacaaaccgcggccccagatcccctcattcaagacgtcgaagcaccgtacacaccatcccggaacctggcattccaggcagcgcgcggggtcgtgccggagccgaccggcatagggtgggcgtccatgacatggctgatcaccggcggggccggatacatcggtgcacatgtggcgtgggcgatgacggaggccggggagcgtgtgctcgtcctcgacgacctctcggccggggtgccggaccggctccccacgagcattccgctggtgcagggctcctccctggacggggcgctgctgaagcgggtcttcgccgagcactccgtgacaggtgtggtgcatctcgcggcgcgcaagcaggtcggcgagtccgtggcgcagccgacgcgctactaccaggagaacgtgggcggtctcacgaccctcctcgacgcggtggccggagcgggcatccagcgattcctgttctcgtcgtcggcggcggtctacggcaaccccgatgtggacctcatcacggaggacactccctgtgcgccggtgaacccgtacggcgagaccaagctcgccggtgagtggctggtgcgggcggcgggccgggcgcacggtatctcgaccgtatgtctgcgctacttcaacgtggccggcgcggcctcgcccgagctggccgacacgggcgtcttcaacgtcgtccccatggtcttcgaccgtctcacccgcggcgaggccccgaggatcttcggcgacgactatccgacgtccgacggcacctgtgtacgtgactacatccacgtcgccgacctggccgacgcgcatctcgcggcggcacggcggctgaccgccggcgccacgggcgacctgaccgtgaacatcggccgcggcgaaggtgtctcggtgcgcgagctcatcacgctgatcggcgaggtgagcggcgacaccacccccgccctcgtggagccgcgccgtcccggtgacgccccgcgcgcggtcgcgtcggccgcgctggccgccgaggagctgggctggcacgcccggcggggggtgcgcgagatggtggagtcggcgtggcggggctggcgccatcaccaccccgaagcggcgcgcggatagccaacccgcgtgaggagccaacccgcgtgaggtgcggatagccacacccgcgtgaggtaggggggacccgcacgtgaggtagggggtacgcgcgcacgcgcacgcgacgtacggggggcgtgcaggcgaagcggggcgcgggctcgtgcgcggtcgcccggagtgtcgacacgggcgattcccggtgcgcggcaccgggcacgatcaggtatccggccgctcccggagtccgctcgggaccggccgcacgggccgttccggggcaccggggtgggacatgcgggaagtcgcgaagtgccgggagtgccggattcgtacggcagacttgggctggaagaccgatgcgaaggatgggtatgccgatcacacctgccacctcgacgcacagttcgtcgaacggcaccgctgaagcgatcttgctggagctggtcgacgagaacggcactacgatcggcacggcggagaagctcgccgcccatcagccgcccgggcagctgcaccgggcgttctccgtgttcctcttcgacgagcagggccggctgctgctgcaacagcgcgccctgggcaagtaccactcccccggcgtctggtcgaacacctgctgcggccacccctacccgggcgaggcgcccttcgcggcggccgcccggcggacccacgaggagctcggggtctccccctcgctgctcgccgaggcgggcacggtccgctacaaccacccggacccggactcggggctggtcgagcaggagttcaaccacctcttcgtcgggctggtgcagtccccgttgcgccccgacgccgaggaaatcggcgacacggccttcgtcaccgccgccgaactggcggagcggcacgcgaaggacccgttctcctcatggttcatgaccgtcctggacgcggcccgtccggcggtccgggagctgacgggcccgtccgcgggctggtgagccgccgtaccgcggcggacgggaacacaccggcggaccagcacatgccgacgggccagaacatgcccacgggctagaacatgccgacgggcttgagcggcacggccgcccagatcaccttgccgccgctcgccgtgtgctccacgtcgcacaccccgcccgcctccctggtgatctcccgcaccagaagcagtccgcgtccgccggtctgcccgtggtcggcctccagggcggtggggcggtaggggtggttgtcctccacggagatccgcagccagtcggccccgacggcgacctccaccgccagcatcggtgacagcagcgccgcgtgcctgacggcgttggtgaccagttcggagacgatcagcagcagtccctgggcgaggtcgcgggagacgggcacgccctgacgggccagcaggtcccggacggcgtgccgcgcctgcggcaccgaggcgtcgacggcgggggcggtgtaccgccagaccccctcgtacggcagcggggcgggaggtctcccgtcgtcgggcatgtccgcgccgccttcagggcgtgggccggtccctcgcccttggtcgtccatcgtccggtcgccaccctcgcgctcgattgtcaccacacgtcgagtgttggtaatgcgctggtccataccgaatgactgaacagaaatcagcgattatcggcagatcccgaccgcctgtgcacgatgggatcgaccgcgggatcacccctgtccgtgtcgtgccgacttcggaacttttcgggttgtacgggtttggaggggggagagagcccgcccctcctcgatccggcgttcggcgggtgcggatagcatccggcacatggagccgcagctgctgcacagcgtcgccgacggggtggccaccgttgtcatccaccacccggccaagcgcaatgccatgaccgcgggcatgtggcgggcgttgccgtccctgctggacgagttggcctccgacaccgccgtgaacgcgctggtgctcaccggccagggcgacacgttctgcgccggtgccgacatctcgaccctgctggactcaccggacgaggcgcaggcgctggccgcgcgggccgaggagtcgctcgcggccttccccaagccgaccctggcggcggtccgcggatactgcgtgggcggcggttcccagctcgcggcggcctgcgatctgcggttcgccgaggcggggtccctgttcggggtgacgccggcgaaactcgggatcgtctatccggcctccgccactcgccgactggtgtcgctggtggggccggccaccgccaagtacctgctgttctccggcgagttgatcgacgcggagcgggcgctgcgcacgggcttcgtcgacgaggtgctgcccgagggacagctcgacaagcgggtggccgagttcacccgcgtactgaccgcgcgttcgcagctgacgcaggcggcggccaaggagttcgcgaacggacgcgcggaccgggacacgtactgggcacagcaggcgcgcggcagcggcgacaccgcggagggggtcgccgccttcctggagcaccgccggccgcgcttcacctggactacgtcaggatgaagcggctgctggtgcggaactcctcgacgaggtgggcgggcgccttctgcggggaccccgcgtcgtagggcggctgcgggtcgtactccgtcaacagctgtacggcctgggcgtgttcgtcgcccgcgatgcggccgagcagggcgagccccatgtcgatgccggaggacacaccggcggcggtgacgtacttgccgtcgaacacgacccgctccccggtcggtgcggcgccgaaccggtcgaggaggtccagggccagccagtgcgaggtggcgcggcgccccttcagcaggccggccgcggcgagcagcagtgagccggtgcacacggacgtggtccaggtgctgctcgcgtcggcggcccgcaaccagtcgaggaggaccccgttctccatctgcgcggtctggccgggcccgccgggaaccaccacgaggtcggggctcggcacctcggccaggctcttgtcggcggtgagcgcgagggctccggtgtcggcgcggacgggcccggtccgctcggcgacgaagacggtctccgcgccggggaggcggcccaggatctcgtacgggcccacggcgtcgagggcggtgaagcggtcgtagaggacgatcgcgatctgcatggggttcccttccatggagttcccttcagcgggtgacggtggtgtggaaacggcgccggtactcggccggcgccgtgccgagcgccctgacgaaagcgcggcgcatggcctccggcgtgccgtagccgcaggcacgggagatctcctcgacgccgtccgcggtgtcctccagcaggcgccgggcgtgttcgaggcggaccccgtcgacgtaccggccgggggtcgtgcccgtctcggcctggaaggcgcgggcgaagtggcggggcgagagccgggcgcgggcggcgagcgactcgaccgtgaggtcgtcgccggggtgttcggtgatccactgctggacctcccgcagcggtgcgcgctgcgcggtctgtgcggcgagctgggcactgaactgggcctggttcccgggccgtcgcaggaagacgaccaggtggcgggccaccaagagcgcgacatcacggcccaggtcctcctcgacgagggcgagggcgaggtcgatgccggcggtgacgcccgccgaggtggcgatgtgtccgtcgcgtacgtagatggggtcggcgtcgacctcgaccgccgggtggtcgcgggcgagctggtcgcagtacgcccagtgggtcgtggcccggcgcccgtccaggaggcccgcctcggcgagcaggacggcgccggtgcagacggagaccaggcgctcggcacgggggccgtgggcgcgcagccagtccaccaggcgggggtcggggcggcgggtgccgttgccgccgggtacgagcagggtgtgcgcggcgggggcctcggtgagggagtggtccgggacgagcgcgaggccgctggaggtgcgcacgggcgcgccgtccagggacgccgtacggatgcggtaggtaccgccggagtgtgcctccgcgcccgcgaagacctccagcgggccggtgacgtcaaggctctgcacgtcgtcgaacaggacgaccacaacggtgcgcatgccttcgattcttggcgggccgccggatggccgcaaggacgagtaccccacctttcctgccaagggacgccccgccttccatgcatactgaccagtcggtaacctgcggggcctgaccactcccctcccagagcgcgccgcgcggcgctgccacaacgtcatcaacccgctgcactcggcgcactacttctcgcccgatctggggcgggagatggccgccgtcggtgtcggggacgtccaggccgcctacttcgcggcgcgggccgcggccatggggccggtgggcgccggcgtggtgacggcgacgttccacaacttccgccacgagctggtcgccgcgcatgtgcccggggtgtgggggacggcctctcccgaggtggtgctggcggcacgcgcgcgtgccgtcgacgccacactgcggcggctgctcggcgcggagctgctcgccgccgaggaggtggccgaggcggcggagctggcgctgcgcgcgaccgaggcgtgttccaggaacgcgcgccccctgtacgccgcgcacgccgacctgccggtgcccgacgcgccgcacctggcgctctggcacgcggccaccctgctgcgcgagcaccgcggggacggtcacctcaccgtgctgctcggtgcggaactggacccggtggaggcgctggtcagccacacggcgaccggcaagggcatggcgccgaagtgggccctcgccacccgcggctggagccaggagcactgggaggccgccgttctgcggctgcgcgagcgcggactgctcgacgcggagggcgagttgaccgaggccggaaccgccctgcgcaaggagatcgaggcgcagacggaccggatcgaccgtgcgccgtacgagcacctcggcgccgcgggcgtggcacggctcacggagctggcggcggggctgctgagcagggcgatggcggcgggcgcgttccccacaggcatgatcggcaagagttgaggtacacgttcctctcccgggccgacggtccgggagaggaaaggggaagttcgtgttccgagcaatcgcagacgtgttccggcagatcggcggcgccatcgccacggtggtgacactgcccttcagggccctggcccggctgttcggcggcgcctccaccgcgacccgccgcgggtgacacacccgccgcgcccggcccaccgcgccgccctgatcccccattgtcggtgtcacctgccacaattgccgcgcaacctcagtggagaaggcggtacgggatcgtgacgacacccctcgtagggtccatcgaaggcaggatcgcggaggagctcggcgtacgggagcggcaggtgaaggcggccgtcgacttgctcgacggcggttcgacggtgcccttcatcgcccgctaccgcaaggaagcgaccgagatgctcgacgacgcgcagctgcgcacgctcgaggagcggctgcgctacctgcgggagctggaggagcggcgcacggcgatcctggagtcggtgcgcgagcagggcaagctcaccgcggaggtggaggcccagatccgcggtgccgagaccaaggcccgcctggaggacatctacctgccgttcaagcccaagcggcgcacgaaggcgcagatcgcccgggaggcgggcctcgagccgctggccgagggtctgctcggcgacccgtcggtcgacccggcggcggcagcagccgccttcgtcgacgccgacaagggcgtcgccgacccgcaggccgcactcgacggcgcgcgctccatcctcaccgagcggttctcggaggacgccgacctgatcggcgagctgcgcgagcgcatgtgggtgcgcgggcgcctcgccgccaaggtgcgggacggcaaggaggagacgggcgccaagttcgccgactacttcgacttcgccgagcccttcaccgagctgccctcgcaccgcatcctcgcgatgctgcgcggcgagaaggaggacgttctcgacctcgtcctggagcccgaggagccctccgagcagcccgggccgtcctcgtacgagggaatcgtcgcccaccgcttcgggatcgccgaccgcgggcgcccgggtgacaagtggctgggcgacacggtccgctgggcctggcgcacccgcatcctggtgcacctcgggatcgacctgcggctgcggctgcggacggccgccgaggacgaggcggtcaatgtcttcgcggcgaacctgcgcgacctgctgctcgccgcccccgccggtacccgcgcgacgctcgggctcgaccccgggttccgtacgggtgtgaaggtcgccgtcgtggacgcgaccggcaaggtcgtcgccacggacgtcatccacccgcacgtcccggcgaacaagtgggacgaggccctggccaagctggcccgcctcgccaaggagcacgcggtcgaactgatcgcgatcggcaacggcacggcgtcccgcgagaccgacaagctcgccggtgaactcatcacccggcacccggagttgcagctcaccaaggtgatggtctccgaggcgggggcttccgtgtactcggcgtcggcgttcgcctcgcaggagctgcccggcatggatgtgtcgctgcgcggtgccgtctccatcgcacgccggctccaggacccgctcgccgagctggtgaagatcgacccgaagtcgatcggtgtcgggcagtaccagcacgacctgtccgaggtgaagctgtcgcgctcgctcgacgcggtcgtcgaggactgtgtgaacggcgtcggtgtggacgtgaacacggcctccgcgcccctgctcgcgcgggtgtccgggatctcctccggcctcgcggagaacatcgtggcgcatcgggacgcgaacggcccgttcacgtcccggacgaagctgaagggcgtggcccgcctcggtccgaaggcgtacgagcagtgtgcgggcttcctgcgtatccggggcggcgacgaccccctggacgcgtccagcgtgcaccccgaggcgtatccggtggtgcggcgcatggtgaagtcggcgggcagcgaggtcgcctcgctgatcggcaactccggtgtgctgcgctcgctgcggccggacgacttcgtggacgagaccttcggtctgccgaccgtgagcgacatcctgagggagctggagaagcccgggcgcgacccgcggcccgcgttcaagacggccaccttcaaggagggcgtcgagaagatctccgacctggcgtccgggatggtgctggaaggtgtcgtcacgaatgtcgccgcgttcggggcgttcgtggacatcggtgtgcaccaggacggcctggtccatgtctccgccatgtccaagacgttcgtcaaggacccgcgggacgtggtgaagccgggcgacatcgtcaaggtgaaggtgctggacatcgacatcccgcgcaagcggatctcgctgacgctgcgcctcgacgacgaggcggcggcgtccgagggccggcaggaccagcagggccagggcggcggcggtcgtcagcagcgcggggccggccggccgcctcagcagcggcaacagcagcaacggcaacagcagccgcagcgccagggccgggccggcgggggtggcggcgggggcggttcacgtcaggctccgccgccggccaacagtgcgatggcggacgccctgcgccgggccgggctcgtcgaccccaagcggggcaagggctgagcggcaggggcccgggccgcccggtacgccaccgggggcccgggcccacggtgcccgttcggtgacggcaccggcggttcgggcccgctccgctccagccccgcttcagcgctcgccccgcttcagcgctcgccccgcttcagggcccgccccgcttcagcgctcggtcaccttgccgtccgcgacctccagctgccgtgtcgtgcgcaccgcgtccagcatccgacggtcgtgcgtgaccagcagcagcgtgccctcgtacgagtcgagcgccgtctccagctgttcgatcgcggggaggtcgaggtggttggtcggctcgtcgaggacgaggaggttgacgccccggccctggagcagggccagtgccgaccgggtgcgttcgcccggggacaggctcgccgcggggcgcaggacgtggtgcgacttcaggccgaacttcgccagcagcgtgcgcacctcggccggttccgtgtccgggacggccgcgcagaacgcatcgagcagggcctcggagccgtggaagagcttgcgggcctggtcgacctcgcccacgaccacgctggaaccgagggtcgcgtgcccggcgtccagcgggatccggcccagcagggcacccagcagcgtcgacttgccggccccgttcgcgccggtgaccgcgacgcggtccgcccagtcgatctggagcgtcgcggggccgaaggtgaagtcgccgcgccggacctcggcgtcccgcagggtggccacgacggcgcccgagcgcggggcggccgcgatctccatacgcagttcccactccttgcggggctcctcgaccgtgtcgagccgctcgatcatgcgctgggtctgccgggccttcgaggcctgcttctcgctggcctcgctgcggaacttgcggccgatcttgtcgttgtcgtttccggccttgcgccgggcgttcttgacgcccttgtccatccaggagcgctgcatctgggcccgcccttcgagggccgccctcttgtccgcatactcgtcgtagtcctcgcgggcgtgtcggcgcgcggtctcgcgctcctccagataggcctcgtagccgccgccgtacagcgtgatctgctgctgtgcgaggtcgagttcgaggaccttggtgaccgtgcgggtgaggaactcgcggtcgtgactgacgacgacggtgcccgcgcgcagcccgccgacgaagcgttcgaggcgctccagaccgtccaggtccagatcgttggtgggctcgtcgaggaggaacacgtcgtagcgggagaggaggagggaggcgaggcccgcgcgggccgcctgtccgccggacagggaggtcatcggctggtcgaggccgacggtcagaccgagcgagtcggcgacctcctcggcccgctcgtccaggtccgcgccgcccaggtcgagccagcgctccaggctcaccgcgtaggcgtcgtcggcgcccggggccccgtcgaccagcccctgcgtggcctcgtccatgacccgctgggcctcggccacgccggtgcggcgcgcgaggaactcccgtacggtctcgccgggccggcgctccggctcctgcggcagatgtccgaccgtggcggtcggcggggagagccgcagctctccctcttccggggggagcagtccggcgagcaggcgcagcagcgtggacttgcccgcgccgttggcaccgacgagcccgatcacctcgccgggcgcgacgacgaggtcgagtccggagaagagcgagcggtcaccgtggccggcggcgaggttcttggcgacgagagtggcagtcatgagaaggcaaatcctaacgacccggtggggcagcgcccaacgggatacgggcgccaccggcccggaccaccgatgtcagcgttccatcgccgccaccagcacgctccccgacgtcctcgccaccacgaaggactcgcctttcgtcgccttcgggtcaagggggatccgatggcgtccggcctccaggacatcgtcgaagacctcgtggacgtgggtgcggtacagacggtccagccggtacgccgtgaggcggacccggcaggtggaggtgacctcgatgcccgcctcgccgtcggccgcgaccaggcgggtcagccggcgccgctcctcgggactgcggtccagggcgtgctccgtctgcgccacgaggagcgggatgatcggcgccaggccgtcgatgtacgcgacctcgaccccggcgcgcgcgaaggactgccgcacggcggcacgttccttttcgccgacggcccggccgaaggccaccgcgccgtactcccgtagttcgtcggccgggaccgccgtggcgtcgtgggtgatgtcggcgccgataccgatcgtgcgcagggcggcggcgagcttggcgaggacggcgacgcgggcgccgatcagcaggacgcggcggcgcgggcccgagccgccgtcgaggagggagctgagcgcgtcacggtactcggtgccatggaagcggaacggaccgatcccgtggtagccgttcagctccaggtccgcccgctcgtccgtctgccaggcgaagtcgcgccagacgaaatcctcgccgtccttctcgatgacggcggtgacggccccgcactcgatgttctcgcattcggggcagccatagatgacgtaccggccgtccgcgggcggagcctccgcctccagcagcaggccccggacctgcgcggtgaagatcgcgggtggcacgtcggaggccagtggggagacggcgtcgaggtcggagagctggaacagcagcgggcgcccgtcgacgatgaagtccacgaagtcccggtgcacttggtaatcgccgttggtgaggactccaccggcacgcatcgccggtgccaggccgaaggtcgcgtactcggcagacatggggtgagtattcccagaggaggagcgatgtgagcacggcatgacatattccgctaacgtccgggcgtggagactggtcgaagcggtgaggtcatcgtggtcggcggcggcgtcatagggctgacgacggcgatcgtcctggcggagagcggccggcgcgtacgcgtgtggacgcgggagccggtcgagcggaccacctcggcggtggcgggcgcgctgtggtggccgtatcggatcgagccggcggcgtcggcccgcgcgtgggccctcacctcgttcgatgtgtacgaggaactggcgacacgccccgggcgaaccggtgtacgcatggtcgaaggcgtgcagggcggggcgacgctggaggagaccgaggcgtgggcattgggccgggccctcgggctgcgggcggcgacggccgaggagtgtcccgggggcgggctgtgggcacggctgccgctgatcgacatgccggcgcatctgcggtggctgcgcgagcggttcaccgcggcgggcgggacggtcgagacccgtacggtgaccgacctcgcggaggccaaggcgccggtcgtggtcaactgcacgggcctgggcgcccgtgacctcgtaccggacacgtcggtgcgtcccgtgcgggggcagctcgtcgtcgtggagaaccccggcatccgcacctggctcgtctccaccggggccgacggggagatggcgtacttcttcccgcagccgggccggcttctgctcggcggcacggcggtcgaggacgagtggtccctcgtgcccgatccggcggtggccgaggcgatcgtgcggcgctgtgcggcgtggcgacccgagatcgccggggcgcgggtcctggagcaccggacggggctgcggccggcgcgcggcacggtccggctggaacgcgaaccgctctcggacggacgggtgttggtgcacaactacggccacggcggcgcgggcgtcaccgtggcctgggggtgcgcccaggaggcggcagggctggccgcctcctggtgagcggtcagcagtcggcggccgcttctccggccgtgaggtggtacggcgcacgctcgtcgaggagcagcgggacgagggcgcgcagcgactggcgcagcggtacgaggactgtgccgtcggcgccgtcggcgccctcgtggcgtacgcgcacgccgtgcagggcgagccggtccttgacggccgtgtactgctcggcggtgagccggtagccgcagggcgggttctgaatcacctcggcgggttcggcggggtcgttgtcggcgccgcccacatagaccggcccgcggtcgcggtacccggcgagccgggccgcgtcggtggcggcggcgacccgtgcgccgcgctcgccggtaaagccgaacagacctcccagcgcggccagttgggattggacccgacgccgcttgttgagtgatccgtccgtctgttcggcgtccgtgagggggtcgacgcggctctcgatgagcagtccggcggcgtgtttgacgcctgacatgttccgcaggatccgctcctgtccgtccccggcggtctgtttgaccggatcgccggtgacgggatcggtccagatgccgtaggtccctgtcgtgtaccccgcccgctgggcggccgggcgcacatacgcctgtgacagggtctgtgcctcgtcgtgcaccgtggggtcggtgttgaggttgcgcggccagaggtcgaacaggtccttgtcgtagtacgggggcgtggccccgtactcgtgcaggtcgtagatcacgtcgggccggcggtcgcggaggaccgccgccacggcacgggcctcggcggtccgcagttccaggtggtcgcggttgatgtcgacgccgtcgctgttgccgcgggtgtcggcggcccggccgtcggggttggcggtgggcacgacgagcagggtggtctgtttcaggaagcgccgggtatgcgcgtccttcgcgtacgcgagatcgcggacggtggtcaggcaggcctcgcgaccggagggctcgtccccgtgctggctgcagacgagcagcacggtggcacgggcgcggtgtccgcctccgacccggacgaggtccagcggccgcccctgctcggtcgtgccgatacgggcgagggacacccgctcgctcgtcctgtcgagcgcggtcaggaagtcctgctcctcgggctgcgtggtccagcgggcgccgtcggtctgctcgaatcccgtacgcggcgggggttcggccgcgtgcgcgggtgctgtgagcaggggcgcggcgagggccgccgccgcgagggcgacggcgctcatgcgtcgggtcgtcacaggccgcctccggggacgcggtgcgcggtgtgcggctcacgtacgccgtcgaggacggtggcgtccgcggcggtgccggactgggcggtcgcccgggtgaaggcggcggcgcctccgacgagcgggacccgggccgaggtgcgggccaggtcgagcgtcagggtgggcgtgctcgacggagggtcgatgaggtccttgtcggtgccggcgacgatcagtgcgagccggtggcccttcgggacgacgtggtcggtggcggcgaggtcgagggtgatcgtgtacgccttgcccggggtgagcgggacgcccttgcgggcggaggcgtggttgccgaggtcggcccagccgcggctgaggacggtgtagtcgacggcggcggtcgtggcccgcgtgttcttgaagcaggcgctgtctccggccgtgctcgcaccccagcaggtgcggtcggtgagcgtggtgatgccctcgccgccgtcggcgtagtcgcggatcgtgtccgggccgaggtcgacgagtaccgcggacaggtgggccgtggaggtggtcggtgtggcggtgacggtcaccttggaggagccggacagacgcacgtccccggccaggggcgcggtgacgaatccggccttgctcgcggtggactcgtcgatgtgggcggcccagtccgtctcgctcagccgcgggtcgtcggtgaaggtctcggtgccggatccggtacgcagcccgagggtgccgacaccggcctgggtgcccgtgccgggtcgcagcgtcacggcgtccgtgccgcgcggcggccagagcgtggacgtgacccactggtcggggtggcgctcgatgtcggccgtcggctcgcggtcgacgccgttgtcgtagccgaggagttcatggtcgaaccagcggtgcagcgtgtccacccaggcggtgcggcggaagtcgaacgggtcgacgtggccggtctgggacagccagatcttgcgctcgacgccgttcttcgcgagggcgctccaccactggccgaagttcttggcgcggacgttgaggtcctgcatgccgtggaccaggaagacgctcgcccggaccttgctcgcgtccttgacatagtcgcgctcggtccacagcgaggtccagtcaccggtgcgcggcgcctcgtcgacgagcttgcgctgcacggcggcgcacttggtgcgggcgtcggggctgtccacgtagtcggacagccagtccgggcccgagtcgtagagcggggcgcccttggcgaagtagtagtcgtaccaggaggagatggcgctgatgggcacgatggtcttcaggcccttgaccccggtggccgcgacgccgttggcgacggtgccgtcccagctcttgccgatcatgccggtcctgccgttggtccaggtcgccttggcccgggcggtgccggtgcggctggtgtagccgtgcgcccggccgttcagccagtcgatcaccgccttcgccgactggatgtcggagcggccgcccacgtccacgcagccgtcggagcggttggtgccggcgaggtcgacaccgacgaaggcgtagccgcggggcacgaagtagttgtcgtagaagagcggcatccggacgacgtcgccgttcgcgtcgtacgtcttcttctggctctcgttgccgcgtccgcagcaggagtagtacgggctcgcgtccatgatcacgggaatcttgcggccctgccgggcgagttcgcggggacggacgacgtcgacggccacgcggtcggtcttcccgtcgccgtcgccgtcgaggcgggtgtccacccatacggactcccggatggcgttctcgtacgagtagaccggggcgctctcccgtggcgcgccgtgtgcggcggcgggagtcaggaaggcggccagcagggcggcgatgaccgcggtgaccggcgatctccaggtcgtgaggcgcatacggcgcgcacgtttcggcatgggcggaaggtaccccggccaactcccttgcaaaagagggtctgtgagacacctgtggggcggaatcactcatgacgtccgaatggcgatcgtgtgacaggagcggctgtggacatgcccgcggccacagggactgaatagggtccgaacagacttcgtgcccctatgacttggagctcctgtgcaccgcagactcatcgccccgggcgcgctcgcggcctccctcctgctggcgatcccggcatcggccgcgagctactcccccggagcgccgggcatcggcgacccctactacccggcctacggcaacggcggatacgacgtctcgcactacgatctgcggctgaagtaccagccgcggacggacgagttggagggcacggccaccctcctggccacgacgaaacaggacctttcacggttcgatctggacttcctgctcgatgtgagcgaggtgcgggtcaacggcgccaaggcctcgttcacgacgtcgggtcagcacgagctggagatcaccccggcgacgccgctgcccaagggcacgccggtcacggtcgtcgtccgctacagcggggtgccgtcgacgaagagcgcgtacgggttcagcacctggcaccgcactccggacggcgcggtcgcggcggacgagcccgaggctgcctggtggtggtatccgagcaacgaccacccgagcgacaaggccacgtacgacgtgtcggtggccgtgccggacggcacccaggcgatctccaacggcctactgcagtccaccagttcgaaactcggctggacgcgctacaactggcggtccaccaagccgcaggccacgtacctcaccacgctcgccgtcggcaggttcgacatcacgaccgggaagacgtccgacgggatcccggtcatcaacgcctacagcaaggacctcggcgacaacgacggtgccgcgcgggcgagcgtggagcggaccggggagctcgtcgactggctgagcgggtacttcggcccctacccgttcaactcggtcggcggatacgtgcccaacacgaccaccgggtacgccctggagacgcagacccgcgtgtactacagcccgaagcagttcgcgaacggctcgaacacctccgtcgtcgtccacgaactggcccaccagtggtacggcgacgacgtctccctcgccgggtggaaggacatctggatcaacgagggcttcgcgcggtacgcgcagtggctgtggtcggagcacgagggtgagggcacgacgcaggaactggcggactacgtgtacgcctcgcacccggccgacgacgcgttctggacggtcaagcccggggatccgggtccggacgaccagttcgacaccgccgtgtacgaccggggggcgctggccgtccaggcactgcgcaacgagatcggtgacgacgcgttcttcgccgtcctgaagggctggccgaaggaccacgcgtacgggaacgcggcggtcggcgacttccagaagtacgcggagaaggtgtcgggcaagtcgctggccgccctcttcgacacctggctgttccagccgtcgaagccggccgcgtccgcggcgaagggcgcgtcgctcgcgtcccgtaccgcggcggccaccgtccagccgaggtcctggaagaagatcgccgcgacgaactcggcgcaccagggctgatcagccgggttcccccgggcggccggcggctcgcccacgatccgggtcgccggggccgaggccggctccggcgagccggagacgccgagccgagcccgagccgggcttcggcttcggcttcggcttcggcttcggcttcggcttcggcttcggcttcggcttcggcccatggtcaggtcggcctcggctcggccttgatgcgcgagcggtccccgcacggagggcgcgtccctcgctcagtcgccgtggtcgtagaccgtcaccggtatgccccgccgcacgagccgctccgtgatgagcggctccacgcgtgaccaggtgccgccggccagtccacagccgatgcgcggcaggtggacggacgcgtcgagtgcgacggccctgtcggcgagcagaccgagcgccgcgtcgatcgcctcgtaccgtacgggcacctcgttgtcgctggtgcgtatcccccgctggccgatcatgttggccacccacagagaccgctcgacctggacgaactgggcggcgcccagcccgaagtcgttcgccgcgcggtcccggtaccaggctcggtacgccttctcgggctccggccagcggtgggacacggccagcacgaagccgcttccccagcccccgatgtcgttgcacacatgggcgatcatcttcacgccctcgcccgacggaacggtggcgtcaccccggacatacctgatctccgacatgacgccaccgtaggcactgccactgacagtggccgccgacctgctacttcagctgcgcgagctcccggtcctcggcctgcgagacccggcggcggaccgcgaaccagccgcccaccagcaggacggcgacgagcgggatgaggaggagggtcttacggccgacctcggggtcgttccacatcaggccgagcacggccagcaggaaggcgatcgtgacgatctccgtgacggggctgccgaacagccggaaggacggccgggtcaccaggcccgcccgggcgcggcggacgaacaccaggtggcagatcatgatgatcacccaggtgctgatgatgccgagggatgccacgttcaggacgatctcgaaggcctgggtcggcatcaggtagttgaggccgacgccgaggacgcagaccgcgcaggtgagcaggatgccgccgtacgggacctggctgcggttcatccgcgccgtgaacttgggcgccgagcccgccatggccatggagcgcaggatgcggccggtcgagtagagaccggagttcagcgacgacatggcggccgtgaggaccaccaggttcatcacgtcaccggccgccgggatgccgatcttcgacagcaccgtgacgaaggggctctggtccgccgagtacaccgatccgggcagcagcagtgcgagcaggacgaccgagccgacatagaagaggccgacgcgccacatgatcgagttcaccgcgcgcgggacgaccttctccggctcggcggtctcgcccgccgcgacaccgaccagctccagggccgcgtacgcgaagatcacgccctgcatcaccaggacgaccggcatcatcccgtgcgggaagatcccgccgtggtccgtgacggcgctcaggcccggggtgtggccgccgacctcgtggtgcgtggccagcaggaagatgccgatcagcatgaatccgaccagcgtggcgaccttgatgatcgcgaaccagaactccatctcgccgaagatcttcaccgagatcaggttcacggccaggacgaccgcgagcgcgatcagcgcgagcacccactgcgggatgtcggtgaagaggctccagtagtgggtgtagagggcgatcgcggtgatgtccgcgattccggtcgtcgaccagttcaggaagtacatccacccggcaacgtacgcgcccttctcgccgaggaactcgcgcgcgtacgacacgaaggatccggacgagggccggtagaggaccagttcgccgagggcccggaccacgaagaaggcgaagacgccgcagacgaggtaggcgatggcgagggctggtcccgcgttgtggaggcggccgccggcaccgaggaagagaccggtgccgatcgctccgccgatcgcgatcatgttgacgtggcgggccttgaggtccttgctgtaaccggcgtcgcctgcgtccgcgggcgactgggtcacatcggtgcgcgatgcaaccctggccgtgtctacggcgtccttgctcacgggtggatccactctctggtgcgcccgtggaacgagtcctcgggtctccggatgtgccacggcccgctccgcacgggacgcggcacagaccaaggcgccaccttcccccggcgatcgccgcgcatgcgatggcgcatgtcacatagcggcacatctcacatgttgatcatggggtggacaatcgcccgaacgtcatgcctcacaccccccgccacggggccggacaggcctttcaccccgtggtgagacagcaatactgttacaccgcgtcgccgcccgtactggagggcgatcgccgcgcgatccgggaaggcgaggctgtcatgacgacggacaccggcgagccgacactcacggtcgacgaactggccgcgcgtgcgggcgtcacggtccgcacggtccgtttctacagctccaagggcctgctgccgccgccctcgatcggcccccggcgggtgggccactacagccaggagcacctggcccggctcgccctcatcgaggagttgcagcaccaggggatgacgctcgccgcgatcgagcgccacctccagcagctcccgccggacctgagcgcccacgacctggccctccaccgtgccgtggtcgcttcctgggcgccggacgcggtggagacggtgacccgggcggagctggagcggcgggcgggccggccgctgggcgaggcggacctggagcggctcgccgcgatgagcgtgctcgcccggaccgaggacgcgttccgcgtggaccccgggctgctgccgctgggcgtccagctcctcgacgtgccggtcgcccacgaggcgatcctcgcggcgcgcaccgcactcatcgagcactcgcgcgcggcggcccacgagctgtcgcggctgttccgggacgcggtggccgagcgcgactcgcaggcggtgaagtccttgtcggcgcacatgcagccgctggtcgtgcaggccctgctcaccaccttccagcgctccctgcgggaggagctgcgggagtggctggcggagtcctgagcccctcccgacggggtactacgagcgacgagaccacgtggtgcggtcgcggacgtggccgcacccctcaccagcacgtcgagccgctcaccgatacgtcgagcccctcaccagcacgtcgagccgcccgccacggtcagggtctggccggtcaggagaccgctgccctcgtcgacgacgtacagcagcgtggagaccagatccgccgtgcggaccgcgctcggggcgatcgcgttgaccgtgatgccgtacgggccgagggccgaggcgagtgagcgggtcaggccgatcaggccggccttcgaggtcacgtgggcgaccctcgtcggcggtgcggcgaagaccgccgccgacgcgatgttcacgatgcggccccagcccgccgccttcagatacggcagcacggcgcgggtcaccaggaaaggggcctccaggttgacgcgcatggcccgccgccactcctcgggcgtcgtgtcctcgaagtccgactcggggccggcgcccgcgttgttgaccaggacgtgcagcgtgccgaaccggtcgatgacctcgtccagcgcctcccggacctgctcctcgtcgctgacgtccgcggtcaactccacgtagtccagcacccgtttcgccgtttccggctgcgggaccaggtcgagccccgccacccggaagccgcgccccgcgagcgcgacggcgaactcctgcccgaggccctgtgccgctccggtcaccagggcggtacgtgtctccatgcagcgagtgtggtgagccgtcagggcggcggcaagagcgcgttttcactcgccgggacgggcgggcagggaggggacgggaccggttcgccgctcggcgtccggtcccgtccacctgggcaggagcggcgtgccgctcagcgacacgacacctcgcgccgctcagcgacgcgccgtcgcaggcccctccccgtcgcgctacttcgcgtcgctgaagtgctcgcccttctccgccttctccacgagcagggccggcggcgtgaaccgctccccgtagcgctcggcgagttcacgcgcccgtgccacgaagccgggcaggccggcacctgccccggcgccggcacccggcccgccggcgtacccgttgatgtactggaggacaccgccggtccagcccgggaaaccgatcccgaagatcgacccgatattggcgtccgcgacggacgtcagcacgccctcctcgaggagccggacggtgtccagcgcctcggcgaagagcatgcgctcctgcatgtcctcgaaggggatctcatggcccggcttggtgaagtgctcgcgcagcccgggccacagcttggcgcgcttgccgtccacgtagtcgtagaagcccgcaccgccgccgcgtcccgtgcggccgaactcgtcgaccatgcggtcgatgaccgcctccgccgggtgggtcacccacgtgccgcccgcctcctcgaccgcccgcttcgactcggcccggatcttgcgcggcagggtgagcgtcaactcgtccatgagggacaggaccttggccggatagcccgcctgcgcggccgcctgctcgatggacgcgggctcgatgccctcaccgaccatcgccacgccctcgttgatgaagtggccgatgacacgggaggtgaagaagccgcgcgagtcgttgacgacgatcggggtcttgttgatctggcggaccaggtcgaaggcgcgcgccagcgcctcgtcgccggtccgctcgcccttgatgatctcgacgagcggcatcttgtcgacgggcgagaagaagtgcagcccgatgaagtcggcctggcgctccacgccctcggcgagtgcggtgatgggcagggtggaggtgttggagcagagcagggcgtccggctcgacgatgtgctcgatctcctcgaacaccttgtgcttgagcgccgtgtcctcgaagacggcctcgatcaccgcgtcgcagcccgccaggtcggcagggtcggcggtgggcgtgatgcgggcgaggagcgcgtccgccttctcctgagtcgtacgtccccgggagaccgccttggcgcacagcttctcggagtagcccctgcccttggccgcggcctccgcggacacgtccttgaggacgacctcgatgcccgcgcgggcacatgagtaggcgatgcccgcgcccatcatcccggcgccgagtacggcgaccttgcggacctggcgcggtgcgacgccctgggggcggttggcgccggagttgacggcctggaggtcgaagaagaacgcctggatcatgttcttggcggtctgtccggtgaccagctcggtgaagtagcgggcctcgatcaccagggcggtctcgaagtcgacctgggagccctcgacggcggccgcgaggatgttgcgcggggccgggtagggggcgccgttcagctgcttcttcaggttggccgggaaggccggcaggttcgccgcgaacttcgggttggcgggggtaccgcccgggatgcggtagcccggcttgtcccagggctgctgggactcggggttggcgtcgatgaaggcgcgggcccccgcgagcatctcctcgtgggtcgcggcgacttcgtggacgaggccgttctcgagggcgcgggcgggcgcgtactgggtgccctggaggagcaccttcaggagggcgtcggcgatgcccatgaggcgtacggtacgggtgacgccgccgcccgccgggagcagaccgagggtgacctcgggcaggccgatcttggagccgggcgcgtcgagggcgatgcggtggtgggaggcgagagcgatctcgtaaccgccgccgagggccgcgccgttgatggcggcgaccaccggcttgcccagggtctcgatgcggcgcagggagttcttgatcgccgtaccggtctcgaacgcccgctgggcgtccgacgggccggccttcatcatgtccttgaggtcgccgcccgcgaagaaggtcttcttggcggaggtgtagatgatcccgcggatggagtccttctcggcctcggcgcggtcggcgatcgccgcgatcgacgccctgaaggcctggttcatggtgttggcggactggttggggtcgtcgagaacgagggtgacgatcccggtctcgtcctgttcccagcggatggtggtgggctcagtgctcatcaggggtgctccgtaagatcccttggggagggtcagaaagatccgttgggggtcagacacgctcgacgatcgtcgcgatgcccatgccgccgccgacgcacagcgtggccaggccgtagcgcttgtcctggcgctccagttcgtcgacgagggtgccgaggatcatcgcgccggtggctccgagcgggtgcccgagggcgatggcgccgccgttgacgttgaccttgtccagggacaggcccatgtcccgcgcgaagcgcaggactacggccgcgaaggcctcgttgatctcgaccaggtcgatgtcgtcgatgctcagccccgccttggcgagcgccttgcgggtggcgggcgcggggcccgtgagcatgatggtgggctcggagccggagacggcggcggagacgatgcgggcgcggggccgcagaccgtagcgctcgccgacctccttcgagccgatggcgaccagcgaggcgccgtccacgatgccggacgagttgcccgcgtggtggacgtggtcgatctgctcgacccagtggtacttctggagggcgaccgcgtcgaagccgcccaggtcgccgatgtcggcgaacgacggcttcagcttggcgagcgagtcggcggtggtgccgggccgcaggtgctcgtcgtggtcgagaacgacgagaccgctgcggtccttcacgggcacgacggacttctcgaagcgcccgtccttccaggcggccgcggcccgctcctgggagagcgccgcgtactcgtcgacgtcccggcgggtgaagccctcgatcgtggcgatgagatcggcgccgatgccctgcggtacgaagttggtggccatgttggtcatcgggtcggcgaaccaggcgccgccgtccgaagccatcggcacccgggacatcgactcgacgccgcccgcgagcaccaggtcctcccagcccgaacggaccttgacggcggccaggttgaccgcctccaggccggacgcgcagaagcggttctcctggacgccggccaccgtgtcgggcagcccggccgcgatcgcggcgatccgggcgatgtcggagccctggtcgccgacaggacccaccacaccgagcacgatgtcgtcgatcgcggccgggtccagcccggggaaacggtcgcggatctcgtggatgagtcccaccacgaggtcgatgggcttcgtgccgtgcagggccccgctggccttgccacgcccgcgcggggtgcggatcgcgtcgtacacgtacgcttcggtgctcactgatgggcctttcggggagggttggagccggctcttgacggtgtcgaccgaccgggcgggttcggggccggtgggctgacgttcagcagggggcggccgggctctgccgggcgcggtccgtgcgcgtggccgagcgggagggagagttccatcaggcgccctcccccggtccggggcggaggccctcgagcagccgtggtacgccccactcacgggccacgtcctcgacgtgggcgcccggttgtgcgggcccgctccggacggccgtgcgggtcgccgagaagcgtggtgcgggggcgggctgggtgatgccgccgtggtcggtgaaggtgccgcgggcggcgaggtgggggtgtgccggtgcctcacggagcgacaggacgggtgccacacaggcgtcggagccttcgaagaccgccgtccactcgtccctcgtacgggtcttgaagcgggccgcgaccgtctcgcgcagctcgctccagcgggacacgtccttgcggctcggcgcctcgtccccgatgccgagcagctccacgaactcggcgtagaactgctgctccagggcgcccaccgccatgtactgcccgtcggccgtctcgtacgtgccgtagaacgggcagccgccgtcgaggaggttggcgccgcgctggtcctgccagccgcccgccgccagcatgccgtggatcatcgccgccagatgcgccgcgccgtcgacgatggcggcgtccacgacctggccggtaccggtcgcgcgcgcgtggtggagggcggcgagcactccgacgacgaggtagagcgagccgcccgcgtagtcgccgacgaggttggccgggatcgcgggcggctcgtcggggttgccgatcatgccgagagtgccggtcagggcgatgtacgcgatgtcgtgcccggcccgctgggcgagcgggccctcctggccccagccggtcatccgtccgtagacgagcttcgggttgcgggcgtggcaggcctccgggccgacgcccagacgttccgcgacgccggggcggtagccctcgatcaggatgtcggcgcgttcggccaggtcgaggacgccggccggtccgtgctcggccttgaggtcgacgatcacggaccgcttgttgcggttggtcacgtcgtactcgggggcgatcgcgagccccgcgccgcccggacggtccacccggacgacatcggcgccgaggtcggcgaggagcatcgcggcgaacgggccgggcccgatgcccgccagctcgaccacgcgcacgcctgcgagcgggccgtgccccggcgtccttgccactgccatcaagcccccagcactgtgacaccactgatgtgacatcagtgatgttaagaacgtgttccaccacagacaagccctgggcgagcaagcgcttagtctagattccgaacgccagactgtcatggaacacaccggagtgggacattccaccgacgtccacgaggtacggccggcgccggcccgccgaggatgacgcacacctcggtgttcgaccgctcgcacctcacgctagcctcggccaccgacaacggcgcgggctgaggggtgtcatgagcaggctgaaaacggatcgcgcgtacgacatcgtgcttttcggagccacgggcttcgtcgggacgctcaccgcggagtacctcgccgcgcacgcgcccgaggggcttcgctgggcgatcgcggggcgcagcgcgcggcggctggagcaggtgcgggagcggctcgggggcgcctcggagatcggaatactccaggcggacgtcgccgaccccgggtccctgcgggacatcgcccgcaacgcgcgcgtggtggccacgacggtcggtccctacctgaactacggcgaggagctggtggccgcctgcgccgacgccggcacggactacgcggacctgaccggtgagcccgagttcgtggacctcacgtacgttcggcacgacgcacgcgcgcgggagacgggggcacggctggtgcacgcctgcgggttcgactcgatcccgcacgacctgggggcgtatttcaccgtgcggcagctgcccgaaggggtgccgctgacggtcgacggctatgtgcgctcgcaggccatgttctcgggcggaacgttcgcctccgcgctcaaccagttcgcgcggggcccgcagatgctcgccgcggcccgggaccgcaggcggcacgaaccccgagtggtgggccgccgggtgcaggcgccgttgggtgcgccgcggttcgccaaggaggtcggggcgtgggcgctgccgctgcccacgatcgacagccagatcgtgcagcgctcggcgcgggtgctggagcggtacgggcccgacttccgttaccggcactacgcggcggtcgagcagctgccgttcgccgcgggcggggtcgccgccgtcagcgcgctcttcgcggccgcccagctgccgcccgcgcggcgctggctgtccggccggctgaagccgggggacgggccgagcgccgagaagcgcgcgaagagctggttctcggtccggttcgtcggcgagggcggcggacagcgcgtctacacggaggtcgcgggcggtgaccccggctacgacgagacggccaaaatgctcgcggagtcggccctgtccctcgcgctcgacgacctgccgcacacgtccggccaggtcacgacggcggtggcgatgggagacgccctcatcgaccgcctccgcgcggcgggcatcacgttccgggtggcggccaaacggtaagcccccgcagcggccaccccggaaccgagtcgacgggcgcccctcaggcagtcgcctccttgagggcccgtcggcacagggagtcggcccgtcgggtcgtctccgggatgcggtatttcggggtcagcgcgagggtgtgggcgcaggcgtggtcgaggtccacccggtgtcccacggacacgaacacgggtttgacgccggactgggtgcgcagagcccggccgacctcgtcggcgcccgccagcaggggcgcggcgctgcctcgtggggcgccgggatcctcgtacgagaaggtgaacgggttcttcgcgacgccgatcgtggggaggccggtgaggacgccgaggtggctggcgaggccgaagcgacgggggtgggccaccccgtagccgtcacagacgatcaggccggggggacagggcagggcgtcgagggcggccaggaccgtggggatctcccggaaggccaggaggccggggacatacgggaaggagacctcgcccacggccgtggcctcggcgaccacgtccagcgtcgccgcgtccagcacgaccgccgccgccacgaccacgtcgcgttcgtcgtcgtaggcgacgtcgacgcccgtcacacgaccggttccgggcggtgggcccggctcgtcgaggatcactcgtccgcgcaactcgtcctgcacggcacgggcttcttcttcggtggcgggccagcccgcggggatgcgtacggtcgtcatgatggtgacgagcgtacgaccccgcgggccggtgtcacttgttgcccagtgcctgcttcagctgcgacttgttcatgtccgaacggccgtggatgttgcgccgcttggcctcctcgtacagctggtcgtacgtgggccccgccgagcccgtgtgcgagcgctgaccgccgcgcttgccggacgacatgtcgttcgtggacgtcttgctcgccgtcttcgactcaccggaccgggcccgctccttgttcacggtgcgcgcggcgatctcctcggcgcgcccctggctctcgccccggtcctgcgcgctctgcttgatgtgctcgtactgacgttccctcttggggctcgaaccgcgtggcatgactcctcacttcctccgggatcactgcgctccggaaaactggtggcgcacgggtacccccttttcccaggcgaacatcgcccgtcggccgccgcgcgccgaaggagcggtcactactccagacgggccacccgtcccttctcgccggaggcccagcacccccggtccggggtgcagtccacggtgtcgtacgagcccgtgtcgagggtcttccacgtgcggccgccgtccgtggtcaggtccgttccggtggggccgacggcgagggcggcggagccggtgtgcgggagccaggtgacgccggagcggtaggcgggcggaggctgcgcggccgtcgtccaggtgcggccggcgtcgccgctgaccgccgccgcccgcggggacgcctggtcggcccggtagtcgccgccgaccgcgatgccgtgcgtgcggtcgcggaaggcgagcgcgaagacaccgcgcgccggatcgcccgccgggatcggcgtgtcggccgccgtccacgtcagtccgcggtcggcggagtgcagcacgcgcgcgtgggcgccgccgccggtggccagccacgcgtcgcgcggtcccgaggtgaccagacactgtccgccggccgcgaagccggcctcgccgtcctgggccgcgggcatcccggcgccgggcagcaccttccaggagcggcccccgtcgctggtcgacaggatgcggaacgcgccgtcgaccgggtcgctcatcgccaggccgtggcgccggtcgaagaaggcgaggcagtcgtagaaggccttcgcgtcggtgttgcggaaggactcggtccaggtcgcgccgccgtcgtccgtgcgcagcacccgggacgcctcgccctcgccgatggccagcaccacggcgcgccgcgcgtcgaacgcctcgatgtcacggaactccagatcggcggcgcccggcggcgagacgttgcgccagtgcgccccgccgtcggtcgtgcgcagcacggtgcccttggatccggccacccaggcggcgtgccggctgacggccgaaagaccgcggaagcggacgtccgtgccgctgtccttgagctgccagtgcggcgtctgcctgccggcggccgacaagggtgccgccccggcgggagccgccccggcgggagtcgtcagcgctgcggccagggccgccacgcacgctcccacgctcatcagtcggctcgtacgtcttgtgcgcctcgtccgtctcgtgcgtcgcgtgttccccaagcccgtcatggcgggcgaagctagcccactcccccggtggcgtccagatgccctcacccgggaaccgcgcgcctccaccgggtgtcctctccgatatcccggagacgacggatgagaaatggatcaccacaccgaatgttctcggtgacagaggtcactcgaaattcaggtgcacggattggctcattccaacgtctcttcaagtgcctggccacatccgtccggagtccatccagccgtcacaagggagcaaggcgttgtccaccgtcatcgagcagcccgtagaggcccgtctcgtcgccgccgcgccgcggatgccgagcattcccgccacgctccactacgaccggagcgacccgttcgcgatccgcatgaccttccccgccccggcgacgctggagggcgtggaggtctgctggaccttcgcgcgcgagctgctcgcgtccggcatggaggagcctgtgggccacggtgacgtccgggtgcggccgtacggctacgaccgcaccgtcctggagttccacgccccggaaggcaccgccgtggtccacgtccgctcgggcgagatccggcgcttcctggagcgcacgacggagctggtgccggtcggcctggagcatctgcagatcgatctggaccacgatctggcggaactgatgcgcgacgcgtgctgaacgcgtccgcgcgagcgagtggttcgccgcagcgtccggctccgcgctgacgcggacgacgccggggcggccggttttcggtcacggtcggcgcgcccggccggaccacaacattcagcggggttcgtacccccggcgagcgcctgcccagtcaccgggtcgacggccccggtgaccagcatctccgcgctcaggcggtgaggaaggcggacggctcttacccctccccctcacccgaggtcttcgccgcgggccggcgctcagctgctcgtcgcggcgcccgacgtcgacgccgccgtgatcgcgacgatcattgccgtccgcacctcctggatgaccttccgcagtgcgggtgccgccgccccgccgcgttccgtcagctcctcgacgcggtccttgtaccgcttgcggtccttggacggcaccagggtgcgcagttcggccgcggcggccagggccaccagggccgcgtcccggtcggggaccgcggctacgggcagcgggccctccagcacctgccgggcctcggcgcgcagcgcctgcaccgcgggcacccgcgccagctcgtactccacggaggggaagagcccgaacacgcgtctcttctcggcgcgcagatatccgtcggcggcgagctgggcgcgtacggcgtccagcgtgacgcgggcccgcagggtcacccaggccttccacttgcgcggccgggactcctcgacgagttccatcagcccgtcgagaacgggatcaccggtacggccatccgggtcggccggcgtggcgatgccgtccacatcggtgagcagaccgcgctgcgccagctccgtgagggcaccggcgcggaccaggtgatggaggtgagtctcgccgctgaccttgagtttcgtcgtgtcccaggacagcagatagagccgggccggcagtgagagcgagccgtcgggcacggtgcctcctcggtactgggcagggcccacgttaattgcgttgacagcccgcatacccgctcctagcgtgtacaccggttctgttgccgtcgattggagaaggacgttgctcgtctgaggtcctgagacaccgcgtcacacctcactgaccgtgtggtgtgcgctgcgtgcgacctcggcatccgagccgtcctccggtacagggcttttctcatgccctccgccgtgctccggctcattccccgggaccgtcgccccccgcggtgtctcacacgcgttgcccatgaccacctcgagcaaccgcgaggcaccgtatgaccgcatccatcacctgtacgtccctgtccttcgcctggcccgacggcaccgtcgtcttcgacgacctgcaagccacgttcggccccggcaggaccgggctcgtcggcgtcaacggatcaggcaagtccaccctgttgaaactgatcgccggacagctctccccggccgacggcaccgtccgtgtcgcgggcgaggccggctacctcccccagaacgtcgccctcgacaccgccctccgggtcgacgaggcgctcggcatcgccgcgacgcgcgccgcgctgcacgccatcgaggcgggtgacgtggccgaggaacacttcacagcggtcggtgacgactgggacgtggaggagcgcgccatcgcgacactcggcgaactcgggctcggccacatcgagttggaccgcaccatcggcgaggtgtcgggcggtgagtccgtcctgctgcggctggccgcgctgctgctgcgccgcccggacgtgctcctgctcgacgagccgaccaacaacctcgacctgtacgcgcgccgccggctgtacgcggccgtggaggcctggtccggggtcatggtcgtggtcagccacgaccgcgaactcctggaactggtcgaccagatcgcggatctgcgctccggggaggtcacctggttcggcggcaacttctccgcgtacgaggaggcgctcgccaccgagcaggaggcggcggagcgcatggtgcgcgtcgccgagtccgacctgaagaagcagaagcgtgaactgatcgacgcgcaggtcaagttggcccgccgcaagaggtacggccagaagatgtacgagcagaagcgcgagccgaagatcgtcatgggggcgcgcaagcgggcggcccaggagtccgcgggcaagcaccggatcctgcacgaggagcgactcaccgaggcccgggagcgcctggacgaggcggccgaggcggtgcgggacgacgacgagatccgcgtcgacctgccgtacacggccgtaccgccgggccgctccgtgctcactctccaggacctggagttgacgtacggcgcccgggtggacggcggcctcgaactgcgcggtcccgaacggatcgcgctgatcgggcgcaatggcgcgggcaagacgacgttgctgcgcacgatcgcgggcgagttgcaggcggtgtcgggtgaggcgcgggcccatgtgccgctgcggttcctgccgcaacgcctcgacgttctggaggacgagctgacggtcgccgagaacgtggcccggttcgcgccggacgccacgaacaaccgcgtccgggcgcggctggcccgcttcctgttccggggcgcgcgagccgaccaacgggccgcgaccctgtcgggcggcgaacgattccgggccaccctcgccgcgctgatgctcgccgagcccgccccgcagctcctgctgctggacgagccgacgaacaacctcgacatggcgagcgtccggcagctcaccacggctctggagtcgtacgagggcgcgctgatcgtggccagccatgacgtgccgttcctcgagtcgatcgggatcacacgctggctgctgctggaggggaagctgaaggacacgacgccggaggaggtggggatgggctgagggggtgggccgagggatgggccgaggggggcgcgcttccgctcccgcgccctcggcgcgcccgcggccgtcccgctcccgcgccgcaggccccccgtcgcaggcccccgtcacaggcgccccgtcgccgccatgcctgccaccgctgatgcccacctgcggttcccgtgcggcggggggtgcaggaggccgtcaggacccgtcacggccaccgggactgttgtgcggcgggggtcgccctgcatgatggcggcgtaccccctgccgagacggagacccgcacgtgcccagcaagaaggccctcatccgccgccccagcccccgcctcgccgaagggctggtcacgcacatcgagcgcgcgcaggtcgatgtcggcctcgcggtcgagcagtgggaggcgtatgcggaggcgctgcgcacgcacggctgggagaccgtcgaggtggatccggccgacgactgcccggactcggtgttcgtcgaggacgcggtggtcatgtaccgcaatgtcgccctgatcacccgccccggcgccgactcccggcgcggcgagaccgccggcgtcgaggaggccgtggcccgcctgggctgctcggtgaactggatctgggaacccggcaccctcgacggcggcgacgtcctgaagatcggcgacacgatctacgtaggccggggcgggcgcaccaacgcggccggggtccagcagctgcgcgcggtcttcgagccgctcggagcccaggtcgtcgccgtgcccgtcagcaaggtgctgcacctgaagtcctcggtcaccgcgctgccggacggcacggtcatcggtcacatcccgctcgtggacaggcccgcgctgttcactcgcttcctctcggtgccggaggagtccggctcccatgtggtcctgctcggcggatcgaagctgctgatggcggacagcgccccgaagacggcggacctgctcgcggacctcggccacgagcccgtcctggttaacatcagcgagtacgagaaactcgaaggctgtgtgacatgtctctcggtccggctgagggagctgtacgcctgacccggttgatgtaacgccgttccggcccccggacctgcgggtgcaccggcgtccggcatgcgggcggtgtccgtgggggaaccctgctgatcagcagtctttacagcgtgcttaacctacggtctcgtaacctacggatacgtagcctacgatgccgtaggttgccgggcccgccgctcgtggccccgctcgctgtacttcacgtccccctggagcacctgtgacgatcacctctccccaccttggcagcacgtccgactggaccgacgctcggctgctgtacgcgctggaggaagtggtcgagaacgagttgaaccgccacctgaaggtcgccaaggactggatgccgcacgactacgtgccctggagtgacgcccgcaacttccccggcctcttcgaggacggcgaggcgtgggacaaggagcagtccaaggtcaccgagatcggccgcatcgcactggtggtcaaccttctcaccgaggacaacctccccagctaccaccacgagatcgcctccctcttcggccgcgacggcgcctggggcacctgggtgcaccgctggaccgcggaggagggacgccacggcatcgtgatgcgcgactacctgctcgcctcgcgcgccgtggacccggacaagctggaagccttccgcatgtcgcacatgagcgagggcttcgagtcggacaaccggcactcgatgctgcactccgtcgcgtacgtcgccttccaggagctggcgacccgcgtgtcccaccgcaacaccggtcaccagtcgggcgacccggtctgcgaccgcatgctggcgcgcatcgcgaccgacgagaacctgcacatggtcttctaccgcaacctgctgaaggcggcgttcgagctcgcgcccgacctgaccatgcaggccgtgcgggacgtcgtcgtcaacttccgcatgcccggccacggcatccccggcttcgagcgcgcggccgcgcagatggcgatcggcgaggtctacaacatgcgcatccaccacgacgacgtgctccagccggtgctgcgccacctgaaggtcctggagatcgacggcctcagccccgagggcctgcacgcccaggaagagctcggcctcttcatgggcgggctggacacggaggcccggaagttcgacgagaagctggcggcccgcaaggcgcggatggcggcgcgagccggcgcgtagccgccttcggcgccggttcaggcgtcttcagcagcgggcccgtgcctctgaggcacgggcccgctgctcattcgtacgccgtcagctgcttgcgggccagcgtgcgcaggacaccgggacccagcccgcggtgtcggcggacggcgtgccaggcgggagtgagcaggagacgcaggagccgcccgggggcggccaccgcgaagtcgcccaggtgcttgcggagtcggggtggcatcgtttcggggccgaggcgttcgagcagggcgcgtgcgcgcaacggttcggccgtgacggtggcggccacggcgggcgcgtaccggctccaccagggggcgcgcagcgcctcggggagcgtggccagcgcttgttcggccgcgtcgagcaccgtgcgcgggtgcctgttggcgagggtcttccagccggtgacggcgtggaagaggccgggcaggagccgggcaacggtctccggcgcgcagcccggcagcagccgcgccgcctcggcgtcgccccagtcgcgccgcagcccgtccgccagccggtcggcaagtgccgtgcggcggcccacgactatcccccgcagcagatcacggcatacggcctcgcaggcgtcgccgagcgccgactcgtagacggtgtcggggacttggaggctgtcggcgacgcgcagggcgtggccgcgcacgaagggctcggcgtccgcgatgcgctccgcgatccactgggtgccccgggcgacggacgccgcgaccaccgcgatgccccgctcatacgcaccgcgcgcctcgagcacggggcgcggtgggctcatgacccgcacatggagggcgagttcacgcatgcgccgcgggtacggcagcggagcgagagcgctgaggagactgtcggccgtgtggaccggagtgccggccaggcggggattgtgcctgccgggggccgtgcggcgtaccgatttcccggtgcgggcgttcagcgcgggtcgcgcctgaggctcagccgttccttctcggagagcccgccccagaccccgaaccgctcgtcgttggtgagcgcgtattcgaggcaggcggagcggatctcgcacaggccgcagatgcgcttcgcctcccgtacggagctcccgggttcgggaaagaagaaatcagcccccgtctgcgcgcacagcgcctcctcctgccaggcgatgtcgggcgacgtgatcgtttcggtgtgcatgggcgagatcgtgccgggcggcgaaaaacgttcgatcaacgcgggatcaacgtcgtgttccggaggcggtgtccgaccccgtacgtggctgtcgcaggcgttgatgatggtcccgcccgtcccggaaaacacggcggcgcgcggagtcggcagaaacacgggaattcccgctgctcaccgagcgtcatcaccctcgtcccgcaaccccgcggcgcgctgcggcggcgattgtcagtgggcggtgcaagactcggcagtgcaggcaacgggacccctcaaaggagggcaatcatgctcaccacccgttatgtcaccggtgctccgaactggctcgatgtcggcacccccgacatcgacggcgccacgtccttctacggcggcctcttcggctggcagttccagtcggcagggcccgacgccggtggatacggcttcttccagctctccggcaagaccgccgcgggcggtatgcagacgactccggaacagggcccgccgtcctggaccgtgtacttccagagccccgacgccgaggccaccgcgaaggcggccgagcaggccggcggacatgtgttcctgccgcccatggacgtgatgggccagggccacatggcgatcctcgccgaccaggcgggcgtgcccttcggcgtctggcagccgggccggaacaaggggctggacgtggccggcgcccccggatcgctgtgctggatcgagctctacacaccggacatcgcgcgggccgccgcgttctacgacaaggtgttcggctgggagacctcggcggtgccgttccccggcggcacatacacctgcatcaacccggcgggtacggagccggaggccatgttcggcggtgcggtcccgctccaggacgacccgacggaggccgagtcgggtgcgtactggctgccgtacttcgaggtcgaggacacggacgcgacggtcgccgaggcgcaggagctgggcggcaaggtccggatgcccgcgacggacctggaaggcgtgggccggttggccaagctcgccgatccgtacggcgcgaggttcgcggtgatcaagagcacgccgccgcagggctgaaccgaaggcagaccgtcgcgtgcgggcgtggccgtccgggccacgcccgggagcagaggtccgcgtccgcgcgccggcgatccttaggcggaggcgcgcctgaccagtgtcgtcggcaggaccacgccggccggggtgccggccgggcccgccgcctcgccacggcggtccaggccgctcagcagcaggcgggccatcagccggcccatctcctctatgtcctgacggaccgtggtgagcggcggatcggtctgttcggcgaccggcagcatgtcgtcgaagccgatgagcgcgacgtcctcgggcacccgccgcccctgctcgcgcagcacccgcagggcgccggaggcggacagatcgttggccgcgaacacggcgtccacgtccgggcagcgctccagcagctcgcgcatcgcccgctcgcccccagcaggtgtgaagtcgccctgcacgaccagccgggggtcggcgtcgaccatgacgtcccggaatccgtcgagccggtccaccgccgaggtctggtcgagcggcccggtcagatgggcgacacgggtacggccgagcccgacgagatggcgtacggccgcccgggcgccgccgcggttgtcgcagtcgacgtacaccgcgggcgcggcgtcgcgcgtgccgtcgccccagccgggccgcccgccgaacacggtgggcaccccggcaccgcggatcaggcccggcagcgggtcgtcgaggtgcagcgagaagacgagcgcaccgtcgacatggccgccggcgagatagcggcccacgcgtgcgtggtcgtcccgcccttccgtgagcagcagcacgagctgacagtcatgggcggtcaactccttgctgatgccgcgtagttggagggcgaagaaggggtccgcgaagaccctcgtctccggttcggcgatcacgacggcgaccgcgtcgtgccgcttggtcaccaggctgcgggcggcctggttcggcacatagccgagttcttcgacggcccgccgcacccgcgcgacgaggggctcccgcacaccgtcgccgccgttgacgacacgggagacggtggcccgcgagaccccggcccgggcggccacggcctccagcgtgggacgcgacgcggtctcggtcacttcgggactcctcctgagcggctgcggatcaggatagccccggccggtaacggcgttgagagcgctcccgagcccgcgcccaggactcctccccgccgcgcgcggacgacccgggcacggacgggcggcggttctcaaggactgccgccggatcgtcgcgaccctcacgggccgtgacggccggcggccggccgtcagccgtccccgtgcttcgcccggctcggctggacgcgtttcggctcgcccggcatcttcggatattcgggcgggtacgggaggtcgcccaggccgtggtcgtgctcgtcgcggtcggcgagttccagcagggcctccagggagaaggcgtggtcgtccatgtccgcgtggacgtcgcccagttcggcgtaccgccggggcatggtcgcgatgtcgaagtcgcggggccgcgcgtccccgacctcgtcccagcgcaggggcgcggagacgggagcgtgcgggcgggggcgtacggagtaggcggaggcgatggtgcggtcgcgggcggtctggttgtagtcgacgaatatcttctcgccgcgttcctccttccaccaggcggtggtgacctggtcgggcatgcgccgttccagttcgcgtccggcggcgatcgcggcacggcgcacctgggtgaaggtccagcgtcgctcgatcgggacgaagacatgcagcccgcggcccccggatgtcttgggccagccgcgcagatcgccgtactcgtgcaggacggcgcgcagttcgtgggcggcgcgtacggcgtcggcgtagtccgtgccgggctgcgggtcgaggtcgaggcggagttcgtcggggtggtcgacgtcgtcgcgacgcaccggccacgggtggaaggtgagcgtgccgaactgcgcggcccacaccacggcggccacctcggtggggcacatctcgtcggcgctgcggccgctggggaaggtgatgtgggcggtggggatccagtcgggcatgttcttgggcgcccgtttctggaagaaggactcgccgctcataccgtccgggtagcgctccagggtcgtggggcggttgcgcagggcgcgcaggatcccgtcgccgacggcgaggtagtactgggctacgtcgagcttcgtgaagccgcgctccggaaagaagatcttgtccgggctggacagccgtaccgtcctgcccgccgcctccagctccaccgcatcgcccatgcgagccacggtaggcgcagcacgcagaccgcgcataccgggcgaacatcggcgtgtgcccgcagaatcggagcatggatctgccggtgatgccgcccgtgaagccgatgctcgccaagtccgtggcgaagatcccgccggacatgcagtacgaggcgaagtgggacgggttccgggcgatcgtgttccgcgacggcaccgaggtggagctcggcagtcggaccggaaagccactgaccaggtactttcccgagctggtcgaggcgttgcgggaccggttgcccgagcgctgtgtgatcgacggtgagatcgtgatcgcccgggacgggcggctcgacttcgacgcgctcaccgagcgcattcatccggccgagtcgcgggtgcggatgctggccgagaagacgccggcctcgttcgtggcgttcgatctgctggcgctggccgacgactcactgctcgacactccgctgaccgaacggcgcgccctgctggagtcggcgctgtcgggggtgacggcccccgtccatgtcgccccggcgaccacggaccgcgaggtggccgagcagtggttcgagcagtacgagggcgcgggcctggacggcgtgatcgccaagccgctcacattgcgctatcggcaggacgagcgcgccatgttcaaggtcaagcacgagcgtacggcggacgtggtggtcgcgggctaccgcctgcacaagagcggcccggtcgtcggctcgctgctgctcgggctgtacgacgaccggggcgccctgcaacacgtcggggtgtccgccgcgttccccatgaagcgtcgcgccgagctggtggaggagctggagccgctgcgcatggaagacgccgcggggcacccttgggcggcctggtcgaacgaggcggcgcacgagacggcgcggctgcccggcgcacccagtcgctggtcggggaagaaggacctctcctgggtgccgctgcggcccgagcgggtggcggaggtggcgtacgaccacatggagaacggcgcacgcttccggcacacggcccgcttccgccgctggcgccccgaccgcacccccgagagctgcacctacgcgcaactggaggagccggtgagctacgacctgacggagatcctcggctcgcggggctgaccgcgaaccgaagggagtgcggccgggggcggcgtgttcacgctgtcgcagcgccctcttcaccgatccgtactcgttgattcatgcccgctggggagggacagcgcgggtatccgcaggggggtgcatcccggacagccggatcgctggaccgctggatcgctggatcgtcgaagtgcgggcgcgtgctccggtcggcccgttcgtcgactggcccaatcggccgagccgacgcgcgcaatcagaaccgaacgggtatggccaccaatgaacctataagcgcacaatcaatggcacaggacttggtggacggtgggcatgcgacagatggcgcggatgcggcgcggcgtgatgacggcggcactgctggccgccacggtgacgggctccctggtgacgggctgcaccacgcacggccgcgcggtcgacgacggacggaaccggcaacagggccacccggagagccaggtcagcggcagcccgagcgcgacggcgggtccggtactggcggtgaagatcgacaacgctggtgcggcccgcccgcagacgggcctggacacggcggacgtcgtgtacgcggagcaggtcgagggcggtctgagccggctgatggcggtgttcgcgacgaacctgccgaagaccgtcgggccggtgcgcagcgcacgcgagtcggacctggagctgctgggccagttccacgatccgacactcgcgttctcgggggcccagcacaagctgctgccactgatcgacaaggcgcccctgcgggccgtgtcgccggagcaggactcgaacgcctacttccgcggcggcgacaaggcggcgccgcacaatctgttcctgcggccgaagcggctgctgaactccgcaccgggcgccgacgcgctcacgacggggttccacttcggcgcggctcccccgggtggcaccccggagaaggcccgcacggtccgcttccccgcggcccgcttcaccttcacctggtccgagcagcggcagcgctggctggtgtcgatggacgggacacaggcggtgacgacggacggcgcgacggtggcgccggcgaccgtggtcgtgcagcacgtgaaggtgcggcagtccaggttccacgacttcctcggcagcaacaccccctacacggagaccgtcggcacgggcaaggccgaagtcctgcgcgacgggcgggtcttcgacgtggactggcagcggaagtcggcgacggacggcacggagttcacgaccgcggacggctcgccgatgaacttcgccaagggacaggtgtgggtggtgttcgcgaaggcgtgacggaaggcggccgcaccggcccgccgggcggggagcgtccgggcgttcaggtcttcgaggccgtgaggggttccgcgggattgcggagcccctcggcggcgtccgagacccgttggatgaggtcgaagaactggctctgctcctcggccgagaggggggccaggaagacctggttcatccgggccgtgcgcaccgtcagcttgcggtgggtgcgggtgccctcctccgtgaggcgcagcaggaagcggcggccgtcgtgcgcgtcgcggaccttgtcgagcagcccgcggcgactgagccggctgatgacctcggcgatcgtggaccggtcgaggccgacccgctctccgaccgtgcgctggtcgaggccgggctcggccacgagcgcgttcaggaccgcgaactgcggtgaggtgatctcctcggagaccatcgtgttccacagcaggtagtgcgcctgctggagccgccgggccaggtgcccggggtgggtggagaggtccaccgcggccatgtgtgctcctcgctccacgtacgcgtcgccgtcggccgcgcagctgtctgatttcctctgtggttttcgttggtgcactgaacgatacctgccctcggcacccctgtcctgtctcgccaggatgtctctcgtccgcattttccttggggtattgactgccccgggatcggatggcagcgtgtttgaagcctcgaacaaataatcagtgtgctgactaattacgcgctgggcgctcgggagagatggggcttcacggatggacaaggtggtcgccacagccctggaggcggtggccgatgtgccggacggcgcgacgctcgcggtcggcggattcggcctgagtggtgtgccgaacgtgctgatccaggctctttacgagcgcggagtggcgggacttggcgtggtctccaacaactgcggcgcgatggagtcggggctcgcggtactgctggcggccggacggatcgcccgcgtcaccggttcgtacatcggggcgaacaaggagttcgcccgccagtatctggccggtgagctggaggtggagatgatcccgcagggcacgctggccgagcggctgcgcgcgggcggggccgggatccccgccttctataccccggccggggtcggcacacaggtcgcggacggcgggctgccgtggcgctacgacggctccggcggggtggcgttggcgtcgccgccgaaggaggtacgggagttcgacggcaccgagtacgtcctggagcacggcatccgtaccgacttcgccctggtccgggcggcgaagggcgaccggcacggaaacctggtcttcaacaagtccgcgcggaacttcaacccgctggccgcgatggcgggccgggtgacgatcgccgaggtggaggagctggtggaaccgggcgggctcgacccggacgcggtgcacgtgccgggcatcttcgtacagcgcgtcatcgcgctctctccggaacagacgaacgccaagatgatcgagaagcggaccgtttcggcgtccgcggcaaccgggacggtgagcggctgatggcctggacacgcgaggagatggccgcccgcgccgcacgcgagctcgccgacggccagtacgtgaacctcggcatcggcctgccgacgctgatccccaaccacctccccgccggtgtggaggtgatcctggagtcggagaacgggatcctgggcaccggcccgtatccggccgaggagcaggtcgacccggatctcatcaacgccggcaaggagaccgtcacggtcctgccgggagcctccttcttcgactcggcgctgtccttcgggatgatccgcggcgggcacatcgacgtcgccgtcctcggcgcgatgcaggtctccgcgggcggtgacctggcgaactgggcgatccccggcaagatgatcaccgggatcggcggcgcgatggacctggtgcacggcgcccgcacggtcatcgtcgtgatgacccacaccgccaaggacggccaggcgaagatcctcgaggagtgcgcgctgccgctgaccggcagggcctgcgtcaaccggatcatcaccgacctcggcgttctcgacgtcaccgccgacggactgctcctggtggagaccgcgcccggtgtcaccgccgcggagatcgtcgataagaccgccgcgaaggttcgtgtcccggaggagatccgctcgtgaaggacgtctacgtcgtcgacgcggtccgcaccccgatcggcaggtacaacggctcgctcgcctccgtccgcccggacgacctggccgcccatgccgtgcgtgaactcctcacccgtacaccgggcctggacccgtcccggatcgaggacgtgtacttcggcaacgccaacggcgccggcgaggagaaccgcaacgtcggccggatggccgccctcctcgcgggcctgcccgcctccgtgcccggggtgaccgtcaaccggctgtgcgcctccgggctcgaagccgtgatccaggccgcgcgggccatcgcgctcaccgtcgcccaccaactcgcccgcaagggctcgggagtcggtgtcgccaccctctgcatcggcgtgggccagggcctcgccctcgtcctcgagcgataggaagacgcacccatggctctcactcagtcgcacatcgacatagaggtcgacgacctccagaacgcgtacgacaaggcggtcgccgagggcggcccggtccgccaccacccgccgcgcgactacgccccgtaccgcagttccgtgctgcgtcaccccaagcagccgctggtcgccgtgcacggcggggacccggagacggtggagctggcgggtccggtcttcggcgtcaccgacatcaccgagatcgacaacgacctgacccgccagcaccggggcgagccgatcggcgaacgcatgaccgtctcgggccggctcctcgaccgcgacggccgacccgtgcggggccagctggtcgaggtctggcaggccaacgcggccggccgctacgcccatctgcgcgagcagcacccggcgccgctcgaccccaacttcaccggcgtggggcggaccctgacggatgatcagggccggtacacgttcaccaccatcaagccgggcccgtacccgtggggcaaccacaccaacgcgtggcggcccgcgcacatccacttctcggtcttcggcacggcgttcacccagcggctcgtgacacagatgtacttcccgagcgacccgctgttcgcatacgacccgatcctgcggtccgtgacggacgcggcggcccgaaaccgtctgatcgccacctaccagcacgacctctcggcgcccgggttctccctcggctacgcatgggacatcgtcctcgacggtccctccgccacctggatcgaggaaggccgttgagcatgaccgagcggttgctccccaccccgtcccacaccatcggccccttctacgggcacgcgctccccttccccggtggcccggacgtcgcgccccagggccaccccgacacgatcaccctgcacggatacgtgttcgacggtgcgggtgcgccgatccccgacgccctcctggacttctggcaggcggcgcccgacggctccctgacgggtgcccccggctcgatgcgccgcgacccgtcgacgggcggcttcctgggccgcaacggcaccgacttcacgggcttcgggcgggtcgccacggacgccgacggacactacgcgctgcacaccctgccgccgggcaatgccggactgccgtacatcagcgtgtgcgtgttcgcgcgcggtctggtgcaccacctgttcacccgcgcctacctcgccgacggcgccgacccgctgctcgactcgctgcccgccgagcggcgcgccacgctcatcgcggccgagggcgcgaaccgcacgtaccgtttcgacatccgccttcagggcgaaggcgaaacggtcttcctggagttccagtgacagaacccgtcgattccgtcgattccgacgccggcctgctcgcccccgggtggacgggatcccccgcgtcggccgccaccgggaacggtgcgtttctccaggcgctgctcgacgcggaggcggcgctgacgcgggcccaggcggggctcggcctggccccggccgaggccgcgtcggcggtgtcggtggccgccgacgccgtgggcttcgacgtccggtcgatcgcgctgcgcgcccgcgccggcggcaatccggtgatcccgatggtagcggatctgacggcggcggtcggcgcggagcacgggccgtacgtccaccggggcgcgaccagccaggacatcatggacacggcgatgatgctggtcgcccgcgccgcactggacctgatcctggcggacctggagcgtacggcgcgggcgctgggccgactggccgccgcccaccgggacaccgtgatgccggggcggaccctgacacagcatgctgtaccgacgaccttcgggctgaaggcggcgggatggcgctcgctggtgctggacgcccgggaccggctcacgaccgtgcggctgccggcccaactgggcggggccgcaggaacgttggcggccttcaacgcgttcgggaccgaggacacccaggccctcgtgaccgcgtacgcccgtgaactcgggctcgcggaaccggcgttgccgtggcacaccctgcgtacgccgatcgccgatctggccggagccctggccttcacggccggcgccctcggcaagccggcggcggacgtcctcaccctcgcccgcacggagatcgccgaggtcaccgagggtgccgggggcgggtcgtccgccatgccgcacaaggcgaatcccgtcgcggctaccctgatcgccgcctccgcccggcgcgcgccagggctcgccgccacgctctacgcgtcgatggccgccgaggacgagcggcccgccggggcctggcatgccgagtgggagccgctgcgggagctgctccgactggtcggtggggccgcgggccatgccgccgaactggcggagggcctttgggtgaacgcggacaccatgcgggagcacctcggtctcacccaggggctgatcgtctccgagcggctggccgccgagctcgctcccgtgctcgggcgggcccgcgccaaggagctggtgacccgggccgcgaagctcgccgtcgccgagaaccggcctctcgtggacgtgctcggtgaggagcaggagctgacggacctcgatctcgcggacctcaccgaccccacccgctacacgggctccgcgggagccctcaccgaccgtgcgctggagcgacgttgaccaccaaaccgaacggcaggctgtcgcaccaccacgccgagggacccgtcaccgctcccccgctgctcctcggcccctcgctgggcacgtcgtacgcgctgtgggacaaggtcgcgcccgagctgtccgtcacgcaccgggtgatccgctgggacctgcccgggcacggcggctcgccggccggtctgatcggtccgggggcgaccgtcgccgacctcgccgagctggtgctggcgctcgccggctcactgggcatcgaccggttcgcgtacgccggtgtctcgctgggtggagcggtcgggctgcacctcgccgcgcaccacccggagcgggtgtcgtccctcgcggtcctctgctcgtcggcccacttcaacggcgcgcagccgtggcgggagcgggccgagctggtccgccgggagggtgtcgcgccggtcgcggcgacggccgactcccgctggttcacgcccggtttcaccgtgccggagctcgtccaggaccaccgggacgcggacccggacgcgtacgcggcctgctgtgacgcgctggccgcgttcgacctccgtgaccggctgtcgtcgatcaccgccccgacgctgctggtcgcgggccgtcaggaccccgcgacgccgcccgcgcatctgcgggagatcgcggacgcggtgcccggcgcctcgctcaccgagatcgcgggcgcctcgcatctcgcgcccgcggagcgcccggaggccgtgctcgccgcgttgcgcgggcacttcgacgggtatgcgtcgcgcgggatggaggtacgccgccaggtcctcggcgacgagcacgtggaccgcgcgcaggcacggcagacccccttcaccgcccgcttccaggacttcatctcgcgctatgcctggggcgagatctggaccgactccaccctcacgcgccgtgagcgcagcatgatcacgctgacggcgctggtggcgcacggccactacgacgaactggccctgcatgtgcgggcggcccggcggaacgggctcacaccggaggagatcggcgcggtgctgctccagacggcggtgtactgcggggttccggcggcgaactcggcgttcgcggtggcgcagcgggtgctggccgaggaggacgacacggcggggtgaccacgacgacggaccggctgcacggaccggctgcacggaccggctgcacggcgcctgaggggaagcgcctggggagggaagcgcctgacacccggcgttccggctaccggagccccggcccgttgtccagtgcctcctgggcctgcgccaccaggccgtccgcgccgcaggagcgggccagcgtcaggccgcgggtgagttcggtcgccgagcgcgtcgcgatgccgtactccacccgggccgccgcgtgttcgtacgagcacggtgacgcctccagatacgtcaccgcctgcttgtacagcgaagcggcgcgctggccggtctccagggccgcggcgcagcggagtgcttcgccgatcgccgtgtcggtgccgaagcgttcggcctggcggcgggcggtcgccgccagttcggcggcccggcgcgggtcgtcgacggccagtgccctggcgaggtccagcgcccagggggccagcaccgtgttgtggtgaccccgtgcggtggccgccttctccgcggcctccagttcgttgacgccttcctcggtgcggccgagggcgagcagcagccgaccgcgcacggagcgggtgtcgggcagcacgatggtggtcgggtacggcgggccgaagccgtaccgctcggcgatctccgcggcctcctcgacatggccgcgggcgagcagtgtgtcgacgagtccgcaggtcgcggaccagtacaggggcagtccgcggccgacgcgctcggcgatgcgcagggactcgcgcagatacttctcggcctccgtgagacgcccccgcctgcgatggccgaggccgacgtaggaatgggccagggcgagatggccgccgctccatccggcgccctcgtaggcgcgcagcgcctcgttgtagagggcttccgcgcggtcgagccggtccgcgtaggcgtacgcgctggccagcatcatgaggagctcgatgccccactcggtgtcggtccagccgagtccgggcgcgaggcggccgttgacgagggcgcggtcgcagagctcggcgacctcctcggcgttctcgccgcgcgtcatcgcgtcgaagccgcgcaggatgagcagcgcgcgttcggagttgtccttgccggtgcacttcttggcgagctcggcgagggcgcgcacgctggtcggcgagatgtcctcacccgcgtggacgcactcccacatgtagtgcaccgcctggagccgcatccgggccggtcccggttcgagccgggcggcctcggcgtcgaccgtgcggacggcctcctcgacctggttgttgtgcagcagcgcctgggacaggcggaagacggcgtccacgcgtacgtccccgtcgaggcccggcatggcgagcgccgcctggaggtagtcgatggtggtggcgggcgaggtgaggagcgtggcgcagcccagctcgtagagcacgcgggcgtggacgtccgacagcggaggctccagcagggcgcgctcgagacagcgtcgggcggcgtccggggcgccgaccgcgaggtgttcgcgggccgcctcgcgcatctggtcgaccagctccgcgtcgtcgtccgggtgcacttcgaggaggtggcgggaggcggccgcggccccgagtccggaatcggtgacgacctgcgcggccacgccgtgcatggcggtgcgcagggcgtccgggatcgagttgtagacggcgctggcgatcagcgggtgcacgaactccaggtcgccgtccggctgtcggccgttgaccggggcgggttcggtgaggatgcgggccgcgcccagcaggtccgcgcagtgcagggcctcctcgcgctgcatgccggcgagctgggccgcgaggtcgagggagatcccggtgccgaggatcgcggcggcccaggcgaaccgcgtggcgtcgatgccgagtccttcgaggcgggcgacgagtccacggccgcgggccgagcggttgagggcgcgcagttcggcggccgaggactcgctcggctccagctcgctgtcctgcaccttggcgaggagttcgacggtctcgtacgggttgccgccggtgacggcccacacctcgcggcagaacggggcgtcggcgtgcacaccgaccgtggcccgggtgagccctgcggtcgcctcgggggtgagtgcgctgagggtggcgaccgggccggccgcggcggcgatcacgtcgaggtgacgggtgctctcctcggtggcctcgccggggcggcgggcgaccaccacgaggacggacaggtcgtggaggcgctcggcgaacgcggccagccagtgcagggtctcctggtcggcccagtgcgcgtcgtcgatcagcaggaccagcggccactcgcgccgggccagtcggcgcaccgccgcgaccaggccgtcgcacacgccctgcgggtcggcctggcggtcgcccggctcggtgatcccgagcgcgggccccgcgatgtcgtaccagtcgcccaggtattcgcgcgcctcgtcgggcatgagcgcgacgagcgcgggttgcagcaactgccgtacgacattgaagggaacggacgtgacggtctcgccgccgcgtgccgaccacaccgtgcagccgcggctctccgcgatccggcgcgtctcgccgagcagcgcggtcttgccgatgcccgcctcaccactgaacaccagcaggcttcccgagcccgaggacggggagtccgcgcgcagggcgtcgaccgcctccacaagcgcggcgatctccgcgtcgcgttcccacagggaagccgaggcgaccgctccgggccgtacctccgtcatcccgctacctccccagatcgcccaaacggcgtacaggcattgagcctagtcctccgcaggccacgacggaggaggtccgggcacgtgttgccgtgacgggtgacaccgagtgccccagggcgacgcggcagacctccgaccagccgttgtgaaagttattgacagcaaacaaatgggaaattgaaactaactttccaccatcaccgtggcccgggaggaaccggcatgagcatccccgtgcaggactcggaccggcgcgccgcccggcccgagcagtcccgaagggccctgctcgcgggctcggtgggcaacctgatcgagtggtacgagttcggtgtctacggctatttcgccacgatcgtcgcggcccgcttcttcacccccgagggcggtggcgaggtggagggcctggtgaaggcgtatgcgtcgttcgcactcgcgttcttcttccggccggtcggggccgcgctgttcggacgcctcggcgaccggatcggccgccgcccggtcctcatcctggtgatcgccctgatgacggccgccacgaccctgatcggcgcactgcccacctacgccacggcaggcgccctggccccctggctgctcaccttcctccgcgtggtccaagggctttccgcgggcggggagttcgggggcgcggtgtcggtgatgacggagttcgcgccgccgggccggcgcggtctgtacgggtcgtggcagtcgttcaccgtggcgctgggccttctgtgcggggccggggtcgccgcgctgctcgcggtgttcctctccgaggcgcagctcagctcctggggctggcggctgccgttcctgctgacgctgcccctcggccttggcgcgctgtggctacggctgcggctggacgagacgccggccttcgcgagcgggcgcgcgcacccaaacgcgtacgaccggccgcccgcccgccggctggccggggccatcgccctgggcgcgagccgcgtcatgggatgggcggcggccggctacaccttcctcgtcgtgctcccctcgtatctccagagcaccctgcacgccaccttccagcaggccctggtcgccacggtcctcgccaacctcggcttcgcggccacgatcgtcccggcgggcctgctcagcgaccggatcggacggcgtcccgtgatgctgaccggggcagcgctcgtcaccgttctcgccctgccgctcctcaacctccttcaaaacaccggcacttcgaacgccgcgaagggcgtggcggtgtgcgcggcgggcgccgtcgtcggactgatggcgggtcccgggcccgcgatgctctccgagatgttcccgacgcgcgtgcgctgcaccggcctgggactcgcctacgccctgtccaatgccgtgttctcgggatgcgcgggcctcatcatcacggagacgatcgaacggaccgggaacgtggacatccccgcgtactacgcggcggcgacctgcgccgtgagcgcgctggcgctggccacggtccgcacgaaccagaagagtcaagggagttgagagcgtgcgggtgatcggcctgatgtccggaacgtcgtacgacgcgatcgacgcggcggccgccgacctcggcctggccggggaccgtctcgtactgaagccactggggctgatgagcgaggcgtacgactccggcctcagggaggagctcgcggcggcgctgcccccggcggcgacgagcctggccggggtctgccgcctcgacacccggatcgggcaggccttcgcggcggcggccgtgcgggcggaccgtgaactgtgcggcgggcgagccgagttggtggcctcgcacgggcagaccgtctatcactgggccgaggcggggcgggtgtacggcacgctccagctcgggcagcccgcctggatcgccgaggcgaccggactgcccgtggtcgcggacttccgcccgcgcgacatcgccgccgggggtcagggcgcgccactggtcagcctggtcgacctgctgtggctgcgcggccgcgcggggacgtccgtggctctgaacctgggcggcatcgccaacctcacggcccccgacgggaccgcgttcgacaccgggccggcgtgcgcgctgatcgacgcggcggcgcacggtctgagcgggggccgcctcgaccacgacgtcgacggggcgctggcggcccgcggcaccgtgcacgagccgatgctgcgacggctgttggcggagccgtactacgcgctgcccgcgccgaagacgacgggcaaggagctgttccacctcggatatctgcgcgacgcgctcgccggattcgggacactgaccgccgaggacgtgatcgcgacgctcacccggctcaccgcgctgacggtcgcggacgccgtgcgcgcggtgcgggccacggaggtcgtcgcctccggcggcgggacccgcaatcccgtcctgatggagatgctcgcccgggaactgggcgcggtggccctgcgcacctccgacgaactcgggctgccctcggccgcgaaggaggcgtacgcgttcgccgtcctggggttcctgaccgtgcacggcctggcgggcaccgacccggtgagcaccggcgcacggcatcccagtgtgctcgggtcggtgacaccggggcgggacggactgcggctgccgccgcgcgcggactggtcacccgtacggctggtgctggagtgacctgacccgtggaacggcccgaaaatccgcgggcggcccgaaaagcacccccaccctctcatccctctttcacgcgagcctcatacggtggtcccatgacgcaggtgactcctcccgggtggtaccccgaccccgggcagacaagtgacggtcccgccctcgagcgctggtgggacggcaaggcatggacggaccagacccgccccgtgggttcggccgccgcgtggggtccgccggcccatcccccgaccgtcggcgcgtatccggacgggccgcccgcccccgcgcggcgtgggctgcggacgggcatagccgtcgccgccgcgatcgccgtcctggccggcatcggaggcggtgtgtacgcgctgaccaaggacgacggcggcagcggcaacgcctcgaactcacagggaccgggcggtcccggcggccagaacggtcagggcggcaccggtggcggcgagggcggctccggcggtccgggcggcctgcccggcgattcgggcggctccgacggccagagcccggcgccggaccagtccgagccgccgaaggtcaagggcggcggtgccgtctccgacgcgatcaacggcatcagccttcccgtgccggacgactggtacggccaggcgctgaccgcgggcgcgcaggtgtcgtcgaacgactcgtacaagtgccccggcgacacgtccaagaagtgcaccaccggcggggcctactcggcgcccgccgtggcgctgggcaccgacggcagcacgcccgaggaggtcgcgaaggcggacatcgcggcgaacgccaaggagtcctacggcggcaccacctacggcaagatcacctcgcacgaggagctggcctccaaggcggtgaccgtggccgggcagaagggctacctggtccgctggaaggcggtcaccagcaagggcgccgacggctatgtcgagtcgctcgtcttcccgtcgccggcgaacgcgaagcagttggtcgtggtccgcttcggcatcgacgtcgggaagaaggagtcggtgatcgacgagatcaccaagggcatcaaggtgtcctccggcggcggcagcggacagaacgtctgatccgccccgcacaccggacggccgggtggggcgcctctccgctcaagaggaaccccacccggccggggggtgcgcgccgcccccgtccccacggtgcggcgcggtcaggccgacgtccggtcatcccgcggacggcggcctgggtcttcaggtgaggccgagtgccgggagcacggcggcctccacaaagcgtgcgaggtactcctcgtccgcgtactgcccctccaggacggggcggacgcgcaggacaccgagaagctgtgcggggatgtactccagcgccggatggtcggcggcgatctcgccgcgctcgactccgcgccggatcatctcctggagcgcctcgatctcgggctcgacgagcgcgtcgcgcagcgcctgctggagttcctcgtcctgcatcacggcatggccgagcgcctggagcagctgggtgtcacggccggaccaggtgcccgccgcccgtgccgcctcgcgcaggtctccggccagcgagccggtgtcgatcccggagaaccgcacctgccggttggcgcgcagggcggcggccacgaactggggcttcgtcttccactgccggtagagcgtcgacttgctgcaccgggtgctggcggcgacgccctccatggtgagcgcgtcgtagccgcattcacggatctgttcgagcacggcgtcgaagaactcctgctcacgctcaggcgtgatcttggagcggcgcgaggcgacgaccgtctccggtccgtccgctgcctgcgacgtcatggctctgctcctcgctcgtagtgccggtcgcgatcccgtttccgtggcccgcctcacaagagtatatcgatacgtcagtgtaccggtacgcggccgtatcggtacactggcgtatcggtacactgtcgtatcgatgagccttggacaggacccactcccctgccgagtggaccttgtcctgggctcaccgcgcatcacctcaagcaagaacgtcagcaaaggggcccggggatggattccctgacggagcctgatccagaaggggcagccgcggtccagcggccgcccctcgtccgtgagctcctgctcgtcgcggggctcttcgtcgtctacaaagtgggccggcagctggcgaacggccacaccggcgaggccttccacaacgcacagcgggtgtgggacggggagcgcgccctgcgtctgccggacgagggcgccgtgcagtccgcactgctgcacggcgacgccctcgtccacgtcgccaacacctactacgcggtcgtgcacttcccggccaccgcggccttcctggtctggctgtacctgcggcgccccggccactacctgtgggcccgccgggtcctcgccgtactcaccgccgccgcgctggtgctgcacctgacgttcccgctcgccccgccgcggctgctggcggcggccggcctggtggacaccgcgcaggtgtacggaccgtcggtctacggggggaacccggagaccgactcgatggcgaaccagttcgccgcgatgccgtcgctgcacttcggctgggcgctgatggtggcgatcggactgatcgccgcgacccggtcccgctggcgcccgctgtggctgctgcatccgctgctgaccctgatggtgatcgtcggaacggcgaaccactactggctggacgcgggcgtggcggcggcgctgctcggcatcgcgctcgcggtgatccacgcgccggtccggacggccgcggcggcggaccgcacgcccgcgcccgcggacatcgccgtcccggcgacggggctcacggcaccggcgggcgacgccgcaccgccgctcgccggcctggcgggccacgtcgtgccggcgcccgtgggggccgcgccgtccacgggtggcagcggcctcgtgggagcacgccgagcggaagccgaacgagtcggagcgagcccagcggaagcgaacccagcgaaagcgagccgagcgggagcggaacgcgtgggaacggaacgagtgggagcgggccggtgaacgccaccctcgtcgccatcgtcctgtccctgttctccgccgtcgcgtacgcggccgccgcggtggcccaggagcggctcgccgcccggaacaccgacacgggtgcgctgcgtctgctcggcgacaccgcctggtggtggtcggtcgcgctcaacgcctcggccgcgctgctgcacgtcgccgcgctcaagtacgggccgctgaccctggtgcagccgctcggcgcgctgaccctggtggccgcggtgccgctcggggcccgggtcgccgggcggcgggtcagcgcggtcgagtggcgcggcacggcgctcaccctgatcggcctggccgcgctgctcgtcaccgcgtccgggccggcgcccgacgatgtgctgacggtgccggaggcgctggccgtcgccggtgccaccgcggtgctgatcggcggcctgtcgcggccgggagcgcggccggggctgcggcacgcgaccgcctccgggttcgcgtcgggtgtcgcctcggccctcacccagacggtgacggtggccgcgacggaccgctcggactcgctgctgagcgcccaagtgatcgtggtgaccctgctcgtggcggccttcgcggcgggtggcctgctgctgtcgcagaccgcgtaccagggcggtctcggcgctccgctcgccgtcgtgacgctcgccaatccggtggccgcctcggtgatcggcctgtccctgctcggcgaacgcctcgagggcggcccgacgggtgtgctgctggcgttcgtgggagcggcgatcgcggcatggggcgtggtgacgctgtcccggtcggcgcccgcgcccgcgcccgtggcggacgacgaccacccggtcgcggcggtgctggcgctggagcccggatcagcggcgtacgaaccctcgttgctgccccagcagccgaaccccggccatctgacggctcactagtgccgcaacgggcaacgacggcggaagggcggttgcggagatccgcaaccgcccttcctcatgtcgagcgccgcatgccgaacggctgtgtcagccgagcccccgggagtcctgcttgagcgccgtgtcgacggtcagcgccgtcgccacgacgaggctcagcaggggttcggggagctggaagtggatctgcaggacgtagttgtccgcggtcgtgaacatcgtcttggcgaggccttcccaggtcttggtgatcctggcgacctcgttgcccgcgtggtcgacgatcgcgaagttccaggcccgccagttctccgccttgatcgcaccgacctgctggccgtcgacgttcatcgcgaagttgatctttccgatcatgttctgctgaacgatctcaccgacgggcgagccgtccggacgcgacacgatcacccgcgacttgaagatcttcgcggggcgggtcagcagcagctgcggctgaccgtacgcgtcacggatctccagcttgtgggtcatgaactggtcgacgctggagacgaagcgcaggaccttcttgaaggcgttctgcccgacctcggtgaccgagccgagctggttgccgttctggtccatgaccttgtactcgttggtcacctcgatcagcttggccttctggttcaccaccaggaccggctcggtgaacagcgtgccgccgccgaccgcgccggccgcgaccccggcctcctgctgcacctgacgctgcacgcgccggtcgggagccggggcggcctgctgggcgtacgcctgctggggctgctgcgcctgctgcggtacctgcggcgcaccttgggcctgctggtccgcattcgtgtggtcggtccactgagcaccgtcccagtaacgcagcgtctggggcgccccgtgcggatccgggtaccaacctgcaggagtgttcgaatgcgtggtcaccggggcacactaccgcgagacggccggaaggcaaccagcagttggggaaccatcagtcggtgacgatcgccgggtcgctcacaccgggcagaccgttctcgacatgtccggcgaaccggcgcagaaagcccgcgtccgcgtcggacacgacggtcaggtcgtaccagcgcctggcggcccgcagatccaccgtgtgcttgacggtcgcgcccggacgcaccttgaaggaccgcggctttccgccatagccgtcggtgagctcgaggcggaccgtaccgggccccttgttggtgaagaccagccgcacatcgcttccgacgtgccgcgcggtgacctcgggcccggcggccccgccggggcccttgaacacgcgcaggaagccgttcgggccgtgcacggtcaggtcgtacgagccgttcgagtacgccgagttccaggtgtccgacacggtcttgccggcctcggtggtgtacgtccacgggccgtccgtacggttgccggacgtgaccaggaaggcggcaccggcccgggccccggaggcgaaggtgagcgtgaacttcccggccgccgcgtccgccgaaccgtccaccaggggcgcgtaccggagcgggcgggccgggcgcgagccgcgctcctgccggggcagggcggggtgggcgggcggggtcggcacatagtcggggtggcggtcgtggtccggcggccggtatccgtcggtggcgggcagcgcgaccggcttggtgtccttgcgggagaagtcgaaggccgacgtcagatcgccgcagaccgcgcgccgccagggcgagatgttgggctcgtgcacgccgaagcggcgctccatgaaccggatgaccgaggtgtggtcgagggtctcggagcagacgtaaccgcccttgctccagggcgagacgacgagcatcggcacccgctggccgagcccgtacggtccggcggcgtggctcgcgtcacccttgaagaggtccgggccgacgtcgaccgtggacttgccctgcgcggcggactgcggcgggaacggcggcaccaggtggtcgaagaagccgtcgttctcgtcgtaggtgacgaacaacgcggtcttcgcccacaccttggggtcggaggtgagcgcgtccaggacctgggcgacgtaccaggcaccgtagttcgcgggccagttggggtgctcggtgaaggcctcgggggcgacgatccacgagatctcgggcagcttgccgcccttgacgtccgccgtcagctggtcgaagaagccctcgcccttgcgggcgtcggtgccggtgcgggccttgtcgtacagcgggtcaccgggcttggcgttgcggtactggtcgaagtacagcagggagttgtcgccgtagttgccacggtaggcgtcgggtatccagccccaggagccgttcgcgtcgagaccgtcgccgacgtcctggtagatcttccaggagacgccggccgcttcgagacgctcggggtaggtcgtccagctgtagccggcctcctcgttgccgaggaccgggccgccgcccttgccgtcgttgcccgtgtagcccgtccacaggtagtagcggttcgggtcggtggagccgatgaacgaacagtggtacgcgtcgcagatggtgaagctgtcggcgagcgcgtagtggaacgggatgtcgtcgcgcgtcaggtacgccatcgtggtcgccgacttggcaggcacccacttgtcgtacttgccctggttgaaggcggagtgtccgtcgctccagccgtgcggaaggtcctggatgaactgcaggcccaggtcgtccgcgtcgggatggaaggggagcacgtccttcgcgccgtccgactggttccagaccggcttgccgttcgcctgggcggccgggcgcgggtcgccgaagccgcggacgcctctcagtgagccgaagtagtggtcgaaggagcggttctcctgcatgaggacgacgatgtgctcgacgtcctcgatcgtcccggagctgtggtgcgcgggcagcgccgcggcgcgctcgatgctgttggacagcgcggtgaaggcggcggtgccacccgcgagttgaaggaagcggcgccggttgacttcgggcatgagtgagggacctctcgtcctgaggacttccacgggcgggatcgtgacggaatgcgcgcggttggagtgttccaagagcaccaaacgtcagggaagggtctggtggcacccatgtgaaagtcgccggtacgtgaggtgtgcgtcgggccaaaacctctcaaaggagccgcgccgggatagtggtcgagcgcggggaggccgtcgcgggcgtatgtcgtcgggcatccgtccccgtgcgattcacgatcctcgccgtcgaacgccgtggtcgaagcgttcctcgtgatgccgggacaggccccgtccgtcagccatgcccgccgcccaggtaggtgtgcaggaggctgtcgagcgcgtcccgtacgtctgcctcccgggccaccgtcagcagcgcctcggccagcgccgaccggggttcgctgcgggcgacgaccagcccgacccgcggcccgcgtgcggggccctccaggggtacgacccccatgccctccggtacgccgaacatgtgcagccaggcgtgcgagatcacgctggaccagcggccgcccggcagctgcgcgtacagcccggcgacgctgtccgactcgatcgcgggcgtggccgtcgccccgtcggcggcgaagcactcgtcgatgatgcgccggttacgcatccgcgggccgagcaggcacagcggcagggcggcggcctgagcccaccgggccgtcggctgcgcggcgagcggtccgtcgaccggcgtgagcagcacgtaccgctcctcgtacagcgggaagcggcgtacgtggcggagcgtgtcgtcgtccaggtacgtcatcgccgcgtccagctcgaactcggtcagtccgtcagtgatgtcggccgacgacagcgactccagggcgacccgggcccggggactgcggtcgcagaacggggtggtggaagggcggtgaggcgtcagcggcccacgatcagccgtaccgccccgtggaagcgtcggcgtcaggtccacggggtgtagccgccgtccacgcggatggcgtcgatgccgctgatgtgccgggcgccgcagcggtcctggggcagcacgagctgcggcccggcccggtcgagcggggtgccgtcgatgctgaccgcgagcaggacgggggcgcgtccgaagtccgggtcgatctccgcccaggacagcagcgcgtggtgtccgtccgctcccgtcacggcgatcaggaagcgcaggcggtccttgcggcgggcggcgtcgaagaccggtccggcgtccgacaggacgtcgtgcagcagcggcccttcgaaggcgtggtgctgtacgccgctggtggcgcactcgaagctgacccgcacccgatgccggggccaggcgagcagatcggacaccgtcaggcgggccggccgggccagatcaccggtgagggcgagttccgccatcgcgccggcggccgtaccggcagctgcgagggactgactcacgggctaccacctcccgcaggaccgtacccggacacccctcccgtacaaacgcacattccaaccctttggatcggagatcccgcttgtgcaatgagacaggagactttccccttgcatctgcggcagtatcatcagcgcatgcacacctaccggatcggggatgcggccgccttgctcggtgtcagcgccgacaccgtgaggcgcctggtcgacggcgggagactcaccgccgaacgcgacgcgacgggccgccggatcatccccggaccggtcctcgcggcctatgcccggcagttgcaccgcacggagcgggagaacgccggctcctccgcccgcaaccgcctctccggcatcgtcacggacgtgaccctcggagacgtgtccgcgcaggtggagatccaggccgggccgttccgggtggtgtccctggtcagccgcgagtcggctgaggaactgaagctggaaccaggtgttccggcggttgccgtgatcaagtcgaccaacgtggtcgtcgaaagaccgtagaagagtcccgtggtggattcttcgtcatgtgacagagggagtagatccgtgatgacccgttccgcgcgccggacccaccggaccctgaaggtggccggtgcgggagccgccgcgttgctggccctgagcgcctgctcctcctccgacgactcgtcgacgaaggcggactcctccgcatccgcgtcctcctccgcgaagctgtccggcacggtgaccgtgttcgccgcggcctcgctgaaggagagcttcacgaccctgggcaaggagttcgagaaggagcacccgggcacgaaggtgaccttcagcttcggcggcagcgactccctcgccgcgagcatcaccggcggcgccccggccgacgtgttcgcctccgccagccccaagacgatggcgatcgtcacggatgcgggcgatgcgtcggggacgcccgccaccttcgtccgcaaccagctggagatcgccaccctgcccggcaatcccgacaaggtgtcctccctcgaggacctcaccaagtccggcttgaaggtcgtgctgtgcgacaaggaggtgccgtgcggcgccgccgcgcagaaggccctggacgccggcaagctcaagctcaccccggtctcctacgagcaggacgtcaagagcgccctgacgaaggtggagctgaaggaggccgacgccgcggtcgtctacaagacggatgtgaaggccgcgggtgacaaggtggagggcgtggagttccccgagtccgccaacgccgtcaacgactacccgatcgtccggctcaaggacacgaagaacgccgaggcggccaaggcgttcatcgccctggtgcggtccgccgaaggccagaaggtcctgaccgaggccgggttcctcaagccgtgacctccccgcacgacacgtccgacgccgtggccgacaccctgacgggcgggccacggcgcgggcccgggcacgtgcggaccggcttcggccggggcgtgccactcccgctgctcgtgcccgcgctggtggggctggccttcctggtgctgccgctgatcgccctgctggtccgcaccccctggcacagcctgccgggccagctgaccagccccgaggtctggcaggcgctgaagctgtccctggtgtgcgccaccgcggccaccgccgtgagcctggtgatcggggtgcccctggcctggctgctggcccgggtcgagtttcccggacgcggcctcgtccgcgctctggtcaccctgccgctcgtcctgccaccggtcgtgggcggtgtggccctgctgatggcgctcggccgcaacggagtcgtcgggaagtggctggactcgtggttcggtatcactctgccgttcaccaccaccggtgtcgtcatcgccgaggcgttcgtcgcgatgccgttcctcgtcatcagcgtcgagggcaccctgcgggccgccgacccgcgctacgaggaggccgccacgaccctgggcgcctcccggttcaccgcgttccgccgggtcaccctgccgctgatcgcgcccggcatcgcggcgggcgcggtcctggcctgggcccgtgcgctcggcgagttcggtgcgacgatcacgttcgcgggcaacttccccggccgtacgcagaccatgccgctggccgtctacctggccctgcagagcgacccggaggcggccatcgccctcagcctggtgctgctcgtcgtgtccgtcgcggtcctggccgggctgcgtgatcgctggatgaccgcctcatgaccgacaccgagaagtccgcgcacgaggtcatgggtgtccccggcccggccgcagcggggctggacgcccgtctgatcgtcgaccgcggcaccttccggctcgacgtggcgctgacggccgcacccggcgacgtcgtcgcgctgctcggcccgaacggcgccggcaagaccaccgccctgcgcgccctcgccggtctcgtccccctcacgggcggtcatctacgcctggacggcgcgccgctggagcgtacgccgcccgagtcacgtccggtcggcgtcgtctttcaggactacctgctcttcccccacctcacggccctggacaacgtggccttcggcccgcgctgccacggcgcgaccaaggcggcggcccgcgcccgggccgccgagtggctggagcggatgggtctgaccgcccacgccggcgccaagccccgccgactctccggcggccaggcccagcgcgtcgccctcgcccgcgccctcgccaccagcccccggctgctgctcctcgacgaacccctcgccgcgctcgacgcccgcacgcggctggaggtacggacgcaactccggcgccatctggccgagttcgaggccgtcgccgtactcgtcacccacgacccgctggacgccatggtgctggccgaccgcctcgtcgtcgtcgaggacggccgcgtcgtccaggagggcactcccgccgacatcgcacgccacccgcgtacggactacatcgcccaccttgtcggcctgaacctctacccgggacgggccgaaggacacgcggtgcgcgtcgacggcgggccggtgatcacgaccaccgaggacctcaccggaccggtcttcgtcgcgttcccgccgagcgcggtcaccctgcaccgcgaccgccccaccggctccagcgcgcgcaacctctggcagtgcgaggtcgccggtcttgagacccacggcgaccagatccgtgccgacctgaccggcgaactccccctcgccgccgacctgacgaccgtcgccgccgccgagctcgacctccatccgggggccacggtgtgggcatcggtcaaggccgcccagacccacgcctactcggcctgacgcgacgcggcgaccggccgcgttccccggttgcggcccgaacggagtgggccgccgggaagccggtggccgggcgggcccttgccgtcccctgtgcggatctcgatactttgcccatgacatcggcggaatcggacgggccgggaagagtggaccggctcctgcgctacccggtgaagtcgatgctcggcgaggagctgcccgccgtcgaggtcaccgagcggggcctcgcccacgaccgccgcgtggccctgatcgaccgggacaccggcaaggtcgccagcgccaagcacccccgcctgtggagccgtctgctcacggtgaccgcgcaggccgacaactccgcggtacgcatgaccacgtcggacggcaaggagctgtggtcgaccgatccgggcgtggacgaggcgctgtcggagatcgtcggccgccccgtgttcctcaccgacgccccgccgcacgaggcggcccttgaccgcgccgacccggaggacgtcctgcgcgaccacacgaggccgccggtgagcgctcgtaccggccgaatcggcggcggctcccccgaaggaacgttcttcgatttcgcgcctgtccacgtgatgacgacctcgaccctcgcccgcatcgcggcactcgcaccgaacggcagcgcccaagcggagcgttaccgccccaacatcgtgctccgtacgccgctgacccggggcttcacggagaacgactggatcgaccggaccctgcacctgggcaccggcctcgtcctgcgcgtcatcgcccgcacaccgcgctgcgccatacccacgctggcacacggcactgtgccggcggacaccgcggctctccgcgtcctggccgagcacaaccgcgtcaccccgacggagtcgatgggaccgcagccctgcgccggcgtctacgcccaggtgctgcggcccggccggatccggctcggcgatcctgtccactgggcctgaggcgagggctccctgctgcccgagcgggtcacggtgctcgacgcggtacgggctgcgggcgtcgaggtcctccactcctgcgctccccttgaaacagaagaagtcgagcaaagcgcgccgacaggaactggtcgtcgacgcactgcgcccggtcgggctcgcggatgccgccggggcgtacccgtggcagctgtcctcgacctgcctggggagcgggaccagttgcgcacccgggtcgccccgcgcttcgccgagctcaggacccatgtgtacgagcagatccaggcggcgaagcgcggggcggccttcggcctcaggacagatacgcctccacctcactgaactgggcggccggccagccggtgttggcggtgacgttgagcttcaggtaccgcaggttcgtgccgctgggcagggtcacggtcgccgtgttcccggtcgccgggtcgaagcggtagccctgcgaggcgaccaccgtcgagtacgccgagccgtcggtgctgccctgcaccgacagggtctgcgtgcgcgcctgccaggcggtggcgggcggcagcttgaggacgaggcgccggacggcctgggacgagccgaggtcgacggtccaggcctgcgggaaggcgttgttggtggactcccagtaggtgctcgcgtcgccgtcgaccgccttgccgggcgtgtagacgtcctgcgagccggtggcggtggcggggcggcccttggcgaggttgcgggtgggatcggggtcggggttgccctggcccggctgcggccaggccgagcagtccccccaggtgctgctccagcccgcgttgccgccgccgtccgtgagggtgaaggtgcccgagccggccgggtaggggcagttgtagatgcccgccgcgcccacgccggtggcctggacgttgctgaacttggcggcgccctgcgactcggcctggaccacgaccgtgccggtgttcctgaccgtcgccccgtccacggtgacgttcttggtcgcatagccgtgtccgccgcccgacacgaactcgaaggcgctgtacgggctgtcggtgatcgtcgtgccggtgatgctgacgttcgcctcgatggcgctgtcgtacgagtcgacgcgcaacgcgcccatcgggtgctgccagttggggttcatcgcgccggcgcggacgagggtgttgccggagaccgtgatggtgcccgcgagcggggagaaggggtcgaggaacttctggttggagatcgcgatgccgctgccgagggcgttggtgtcggagatcaggttgttcttgaccgcgaggtcggtgccgccgtagatggcgatgccgttggcgaggttcggctgcgagatggtgttgctctcgaagctgctgttggtgtccggcgagtacagcgaccacatggcgagggcgtcgtcgccgttgttgcgcaggaagttgttccggacgcggacgccgcgggcgttgccgttgaggttgagaccgtcggcggtggtgtcgaggatgcggttgttctcgacgacgagattgtcgttgttgccggtgagccagaggccgaccttgaggtgctggagccacatgccggagaccgagctccccggaccgagggacccgttgacgaagttgtccgggttggagtcgacgcgctcggtgacctcgccgatcaccgcgaagtccttgaggtggacgccgcccgaggagctggactggtcgatgaagcgcgaggtgtgcacgacggagtgccagctgcccgcgccttgcagcgtcacgttctggacgccgttcagcgaggaggtcagccggtagtcgcccggcgggatccacaccactcccccctgggctgcggcgatggcgttccggaaggcctgggtggagtcgccctggccgctcgggtcggcgcccttgtcggtgacggagaccgccccggcgggcttggtggccgccgcggcgacctgctcgaagtcggcgacgtccaccgtgacctgggtggacaccgcttcgacggcgatcttgtcgcccggctggacgttctggccgaggagcagccgggcgttgtcgaagaagtgatgggtcttggcgcccgcgatccaggaggtgtcgacgtaggagtacttggaggtgacggccagcgtcttggcgagcttcgtgccgttgacgtacacgttgagcgcgcccgactggccgtcggggacgttgtaggagacgttcaccgcgttcgcggcccgggggacggtgaactcgacgcgctggcccgcgcccagtcgtacggcctggcgcccggaggcctccgaggcgatcgtgccctgggtgtggtcggggccgatcttcgtgccggtcgtggtggcggactccgcctcgacggaggtgaaggggaggtcggcgccggcggccgcgtgcgcggcgggggccagggcgacgagcaggcccgccgccagggcgacggccgcaccgatggctgacatgcgcctgacatatctgaggctgttgctgtgcatgtgctgatcccttcgtggtggggggggacggggatagcgggtggtgctacggcggtctcagatgcgcagccaggccgccgtgtcctgcgggaggcgtccctggtcgtccagggggccgctgctgagcaggagtcgggagtgtgcggggaggccggccggggtgtccgcgaggttcacgacgcacatcaggccctccgtgcgcgcgaaggcgaggacaccgtcgggtgcgggcagccaggtgagggggccgtcggcgtaggccggcctgagccggagggcctcccggtagagggagagcatcgagcccgggtcctcggcctggaggtcggccgcgtacgcggaccagcgtgcgggctgcggcagccagggctcgcccccgaagcccgcgtgcggcgcgtcggccacccagggcagcggcacccggcagccgtcccgcccggggtcgacgccgtgggagcggaagtgcatcgggtcctggatgctctcgcgcggtatctcggcctcgggcaggcccagttcctcgccctggtagaggtagacggacccgggcagggcgagcgagagcagcgcggcggcgcgggcgcggcgggtgccgagagccaggtcggtcggggtgccgaaggccttggcggcgaagtcgaagccggtgtccgtgcgcccgtaccgggtgaccgtgcgggtcacgtcgtggttgcacagcacccaggtggcgggcgcgccgacgggcgcgtgctcggcgagggtctcgtcgatggccgtgcgcaggcgccgggcgtcccaggggcaggagaggaaggagaagttgaaggcggtgtgcagttcgtcggggcgcagatagcgggcgaagcgttcggtgtcggggagccagacctcgccgacgaagacggcgccgtactcgtcggcgatggcgcgccaggagcggtagatgtcgtggagttcgtcgcggtcgacgaacgggtgcggggcgcggccctcgacgaggtccggcaggtccgggtccttggcgaggagggccgccgagtcgatgcgtacgcccgccacgccccgttcgaaccagaagcgcagtacgtcctcgtgttcctgccggacggccgggtgggcccagttgaggtcgggctgttcgggggtgaacaggtgcaggtaccagtcgccgtcgggcagctgtgtccagacgggttcggtggagccggcgaactgggacggccagtcgttgggcgggagttcgccgtgcgcgccgcggcccccgcggaagtggaacagtgcgcgctcggggctgcccgggccggcggcgagcgccgcgcggaaccaggggtgctggtccgagacatggttcgggacgatgtcgacaagggtgcggatgcccagttcccgtgcctcggcgatgagtttctccgcttcggcgagggtgccgaaggccgggtcgacggcccggtagtcggcgacgtcgtagccgccgtccttcatcggtgacaggtaccaggggttgaaccagatggcgtccacgccgagtccggcgaggtagggaagtctggcgcggacacccgcgaggtcgccggtgccgtcgccgtcgccgtccgcgaagctgcggacgtacacctggtagatgacggcggtgcgccaccagtccttctggatgcgggcaggggtgggctgtcccacggtgcgggcctttctgtcggagggtcggcgttcagcccttcgtgctgcccgcgctgatcccggcgatgatgtgccgctggaacacgaggaacatcgcgaccatggggatgctggcgatcaccatcgcggcgatgagcacggtcagctggatgttctgcgacagctggacgagggccacgctgatgggctgcttgtcggtgtcggagaagaccatcagcggccagaggaagtcctgccagacggcgaccagggcgaagatcgagacaactcccaggaccggccgggacatcggcagcacgatcgaccagagggtgcgcagccggccggcaccgtcgatctcggcggcctccaggacgtcgcgcgggatctggtcgaagaaccgcttgaggagatagaggttgaaggcgttggccacggcgggcagccagatgccgagcgggtcgttgagcaggctggtgtggatcagcgggaggtcggcgacggtcaggtacttcggtacgaccagtgcctgggccggcaccatcagggtggccaggatgccgccgaggaccagcttgccgaagacgggcttcagccgggacagggcgtacgcggcggccgtgcagaacacgagctggagcagccaggcgccggtggcctggacgaccgtgttccacaggtgggccggcagctgcatcaggtcccaggcgtcggtgtagccgctgaggtgccacttctgtgggacgagggacggcggggtgcgtgcggcctcgtccggcgacttcatggcgccggtgaccatccagtagacggggaagaggaaggcgagcgcgaagagcagcacgacgcccgtgaacacggtccagtaggcggccttgccgcgggggcgggacagcgtgagcggcgagacgagcgtgcgggtgctcatgagtcctcctccgcggaacgggtcaggcgcagatagaccgcggagaaggcgccgagcagcacgagcagcatgacgctcagggcgcaggccccgccgaagtcgttgtagaggaaggcgtacttgtagatcaggtagaggacggtgaccgtcgcgttctcggggccgccgccggtgatgacgaacggctcggtgaagacctgcatcgtggcgatgatctgaaggagcatcagcatcaggacgatgaaccgggtctgggggatcgtcacatggcggatgcgctggaggatgttggcgccgtccagctcggcggcttcgtagagctcccccgggatgccctgcagcgcggccaggtagatcaggaccgtgccgcccatgttggcccaggtcgccacgatgaccagggagacgagggcggtgtcggcgccgttggaccagttggaggtgggcaggtgcaggaagcggagtgcttcgttggcgaggccggctccggggtcgtagaaccacttccacagcagggcgctgaccaccggcgggatcatcaccggcagatagaccacgaccctgaagaaggctttggcgtgccggagttcgttgaggacgagcgccatcacgaagggcacggcgaagccgatgagcagggcgagcagggtgaaggtgagcgtgttgcgccaggccgcggtgaactcggggtcgtgcaggacgcgggtgaagttggcggtgccgacccactcgggcggtgagcccggcgtgtacttctggaaggcgatcacgaccgcgcggatcgccgggtaccaggagaacagggcgaagcagagcaggccgccgagcaggaaggcgtacgcgtgggcctggtcggcgaggcggcgccgcccgaggccccctcccgggggcggcgccggtaccgggcgtacggcgatcgcctcgacgggccgccgcgctgcggtcttggtcatcggtctcagcctcgggcgaggatgctgtcgatcttgccggacgcgtccttcaggagcttgtcgatgtcggcgtccttcttggtgaggaccgcggagacggcgctgtcgaggacggagtagatctgctgggcctgcggcggctcgatcttcatcctcaggctctggttgccgtcgaggaaggactggtagttctcgacggggacgttggcgttggccttcttgacctgctggtccctggcgtcggcggcgccgctgaacagccggggttcgggcaggcccacgggggcgtcgttcttcttggcgcgggcgtagtcgccgaggaagcccttgccgggggtgaggaacatgaagtcgagccacttcagtccggccttgatctgcgcgggcgtggccttcttgttgaacatgtagccgtcgccgccgatgagggtgcccttgccgccgggcatgggggccagggcgaggtccgtgtaggtgccgcccttctccttcaccaggatcgggatgttgtcgggtgcggagaggtacatgccgagcttgccggagcccatcagctgctggacgtcgttgatgacgaggagctgcttgctgcccatggagttgtcggtccagcgcatgtcgtgcaggttctggagcaccgccttgccctcgggggtgtcgacggtggccttcttgccgtcggcgctcaccacgtcgccgccctgcgagtacagctcggcggtgaagtgccagccgccctggttctgcgcgctgtagtccgcgtagccgacggtgccgccgccgagtgcggcgatcctcttggcggcggcgcgcacctcgtcccaggtcgccgggggcttgtcggggtcgagtccggccttctcgaagagcccccggttgtagatcagccccatcgagtagccggtgcgcgggacgccgtagaccttgccgtcgacggtgtagatgtcgcgcagctgctgctggacggtgtcgtagctcttgaggtccttgacgtacgaggtgatgtcggcggcctggttgacgtcgacgacgtgggtggcgtcggtgaagtacgtgtagaagacgtcctccatctgaccgccggcgagtttggcgtcgaacgtcttggggtcctggcaggggaaggcgtcatgggcgacgacgtcgatgtccgggttcttcttctcgaaggcggcgatgtcgtcctcgaagaacttccggtcgaccttggcgctcttgggcggcatgcagttcacggtgatgcgggtcttgccgtcggccgcatcaccgctcgaaccgcacgcggtcaggacgaacgaacaggccacgagcgcgacacaggcacggcggaacccggagcttctcatcggtggaccccttttgggcaggagcggtgggcgccctgggcaggagcggtgggcgtcgcacactcaagcaccgacgacatcggctcgcaagatgtcgcgcagaatctgtaattattcgacagacgtgtggatctccgcgcgttccgtcaccgcggggcttgcgcggtggatccccgcaccaccagctccggttcgaacaagagctcctcgtccggtacggagctgccgccgatccgcgcgttcagcagctccaccaccgcccgccccatggactcgatgggctggcgaacggtggtcagcgggggttccgtgcagttcatgagggccgagtcgtcgtagccgacgacggagatctgggacggaacgtcaagtcccttgcggcgggcggcccgtaccgcgccgagcgccagggggtcgctggcgcagatgaagccggtgacgccccggtcgatgagccgggaggccgccgcgtggccgccctcgatggagaacatggcccgggcgacgtactcgtccgggaggtccccgagagcccgcgcggccgccagcttccgcgccgagggcatatggtcacccggcccgagcacgagtccgatccgttcgtgtccgagcgaggcgagatgccgccaggcctgctccaccgccacggcgtcgtcgcaggagacggccgggaaaccgaggtgctcgatggccgcgttgaccagcaccaccgggatgttgcggtccgcgagccggcggtagtggtcgtgcggcgcgtcggcctgcgcgtacagtccgcccgcgaacaccacaccggagacctgctgctggagcagcaggttcacgtaatccgcctcggagacaccgcccttggtctgcgtgcacagcacgggcgtgaggccgagctgggcgagcgctccgccgatgacctcggcgaaggccgggaagatcgggttctggagctcggggagcaccagtccgacgagccgggcccgctcgccgcgcagctgcgtgggccgctcgtagccgaggacgtcgagcgccgagagcaccgcctgccgggtggccggggagactcccggcttgtcgttgagcacccggctgaccgtggcctcactgaccccgaccttcttcgccacctcagcaagtcgtcgcgtcatgcgcgcaagaatagcgcaagtaacgcaagccgtttgcgtagcggtgtcagggggccacccagagtccgcgcacatggccgaggtgccgggtcgtcacctcgcgcgcggcctcggtgtcgcgggccagcagcgcgtcgaggagttcgaggtgctcctcggcggaggcccgcagccggcccgcccgggcgagggcggtgagtccgtacaggcgggagcggcgccgtaggtcccgtacgacgtccacgaggtggtcgttgccggcgagcgcgagcagccccaggtggaagcgcaggtccgcctcgacgtacgcgatgaggtccccggccgtggcggcggcgacgatctcccgcgcgaccgggcgcagcgcctccagctcggccgggtcggcggtgagcgcgaggcccgccgtcgtcgggatctcgatcagcgacctgatgtgcgtgtactcgtcgagctgtttctcggagaccgcggtgacccggaagcccttgttcgggacggtgtcgaccaggccctccttcgcgaggtcgagcatggcctcacgcaccggggtcgcggagaccccgaagcgggcggcgaggccgggcgccgaatagacctccccggcgcgcagctcaccggcgatcagcgcggcccgcagggcgtcggcgacccgctcccggtagctgggcttcctgccgcccagcgtgggcagggcggggctgtgctgcgcggccatcgcggtcttcctcctcggggcggggtccccgggcacgggggccgggtcaccggacattatcgacgccgcctacagcacgaaccccgccgggaaggggtcctcggggtccagcaggtactgggccgtcccggtgacccaggcgcgcccggtgaagctgggcaggacggcggggatgccggccacctcggtcgtgccgagcagccggccggtgaaccgggtcccgatgagggactcgttgacgaactcggtgccgagcggaagttcaccgcgcgcgtgcaactgcgccatacgggcgctggttccggtgccgcacggcgagcggtcgaaccagccgggatggatggccatcgcgtgccgggagtggcgggcgtcggagccgggcgcgacgaggtggacgtggtggcagccgcggatggacgggtcctcggggtggacgggcccgccgtccgcgttgacggcgtccatcagggacaggcccgccttgaggatgtcgtccttgcgggaccggtcgaagggcagtccgaactcccccagcggcaggatcgcgtagaagttcccgccgtacgcgaggtcgtacgtcaccgtgcggccgtcggcgagcgtggccttgcggtcgaggccgacgcagaaggacggcacgttcttgagcgtgacggcccgggcggcgccgtcctcgaccgccacctcggcgacgacgaggcccgccggggtgtcgaggcggatcgtggtgaccggctcgacgacctcgaccatgccggtctccacgagcacggtcgcgacgccgatcgtgccgtggccgcacatcggcagatagccggagacctcgatgtagacgacgccgacatcgcagtcggggcgcgcgggaggctggaggaccgcgccgctcatggccgagtgaccgcgcggctcgttcatcagcaactgcctgatgtcgtcgcggtgttcacggaagtacaggcgccgttcgttcatggtcgcgccggggatcgtgccgatgccgccggtgatcacccgggtcggcatgccctcggtgtgcgagtcgacggcgtgcaggacgagtttgctgcgcatctgccggcctccccttacgcgagccccgccgccacggccttctccgtggcggcgcggacggcggtctcctgctcgggcagcagcgggacgcgcggcgggcgtaccgggccgccgtaccgcccgacgacgtccatggacattttgatggcctgcacgaactcgaccctggagtcccagcgcagcagcgggtgcagctgccggtacagctgtgtggcggtggcgaggtcgccgtcgacggccgcgtggtacagctcgacgctcgccgcgggcagtgcgttcgggtagccggccacccagcccttggcgcccgcgaccgcgagttccagcaggacgtcgtccgcgccgatcagcagatcgagttccggggcgagttcggccagccggtaggcgcggcggacatcccccgagaactccttgaccgcgtggatgtacccctcgccgtgcagcgcggcgagcagttcgggcacgaggtcgaccttggtgtcgatggggttgttgtacgcgacgaccggcacgcccgccttggcgacctccgcgtagtgggcgcgtacggaacgctcgtcggcccggtaggcgttcggcggcagcagcatgaccgcccggcagccggcgtcccgggcctgttcggcccagcgccgggcctccgccgatccgtaggcggcgaccccgggcatcacccgcgcgccgccgacggcggacacggccgtctcgacgaccctggcgcgctcctcgggggtgagcacctggtactcaccgagcgagccgttcggcacgactccgtcgcaaccctgctcgacgagccaggcgcagtgctcggcgaacttgtcgtggtcgacggcgaggtcggcggtgagcgggagcgcggtggcgacgagcacgccgcgccaggggcggtggacggtcatgagggtcctctctgggtgaggtgatcgtcggcgggggcctcggctcgacggccgtccgcgggggcctcgtccccgtggtcggcggtgggagcctcgctccggtggccgtcggcggcccgggcgagtacgccgagcggtacgggtcgtgcgaacggcccactggacggggcgagttggcatccggcgagtccggcgaccgcgggcccgcacatccggccctggcaccagcccatcccggcgcgggtgagcagcttgacggtacgcaggtcaccggcgccgagctcctcgacggcctcccggatcgcaccgccggtgacctcctcgcagcggcagacgacggtgtcgtcggtgacccggtcgctccagtgggcgggcggcgcgtacacggtgtcgagcacggcggcgaactgccgcagtcgggtacgggacttggcggccgccgcccaggcgcgcgggtcgggttcgcggcccgcgagccgggcggcgatcgaccgtccggcgatgtgcccctcggcgagcgacagcgcggcgcccccgatgccggtggtctcgcccgcggcccatacaccggggacggaggtgcgctgttcctcgtcgacggagacgttcagcccgtcgacgcgacagccgagcgtctcggcgaggtcggtgtgcgggagcatgccgtgtccgacggcgagggtgtcgcagaggatgcgccgctcggtgccggtccgtacgcgtccgccggcatcgagggcggcgacggtcacggctgccagccgctcaccgccgtgcgcctcgacgacggtgtgccggccgaggaactcgacacggtgccgcaggagccgagccgcgtaccgggcgccttcgggcagcttgaccgcgagagcgcgcgcatgccgtacgagcgtcttcgggtccgccgcctccaccagcgccgcgacctcgacgcccgccgcggccagcccggtcgccacgggcagcagcagcggcccggtgccggccacgaccgcggtaccgcccgccaccgcgaggccgcccttgagcatcgcctgcgccccgcccgcggtcagtacgccggggagggtccagccgggaaacggcagcaccttctcgtagccgccggtggcgaggaggacggcgtcggcgtggacgacgaccgggctctccgcacgaagggcgtggaccgtgaaacccgtcgactgcctttccacgagccacacctgatgttcggtcaggtgcttgactcctcctgttccgacctgtgcggcgagcccgtcgcgcagccgttcccaggtccgccaccgatggtgcagaacctgcggtcgccgcgcctcgagcgcggggtcgggccggcggtagaactgaccgcccgcctgggcagccgagtcgatcagcgtgacgcgcactccgcgcgcgcccgcggccagggcggcggcgaggcccgccgggcccgcgccgatcacggccagctcagccctggccgattcagccctggccggctcagccctcatggccggttccctcctgtgtgcggatcacatcgcctggccgcacccgtaccaggcaagcccgttggttcggggcgccgttgacgctcagcaggcagtcgaagcagacgccgatcccgcagaacaccccacgcggtcggcccccgccccgagtggtgcgccacgcggtcacgcccgccgaccacagcgcggcggcgaccgtctgcccgggaagcgcctcgatctcgcgcccgtcgaaggtgacggcgaacgccgcccccggccgcgcgtggacgagtctcagtggattcacggcgtctcctggtcctcgcggcgatccgcaccgcggtgcgcaggacggtccggaagagcgcccggaaggccgtcctgggaacggtcggggaagtggccggaaaagcgctcgggccggaacggcgtcaggtccaggtcggggtcccggccggccagcacctgggcgatcaagtacccggtgccggtggccagtccgatgcccgcgccctcgtgcccgcaggcatggaagagccccggcacgcgtgcgtccgggccgatggccggcagatggtcgggaaggtacgggcggaagcccacgtacgcccgtacggcgtgcacccccacgaggaacgggaacagccgggtcgcgcccgcggccagctcccgcacgaccggcagtgagaacgtgcggtcgaagccgacccgttcacggctggcaccgatcagtaccggccccgccgccgtgccctcgacgaccggcgaggtcgcgagggccgccgagtcgctcgccacatcggcgacatagtccgccgcgtacaccttgtgccaaatcatccgcggcagcggctcggtgacgaggacgaagccgcgccggggcagtacgggcagccggacgcccgcgagccgcgccacttcgccgccccaggtgccggcggcgttgacgacggcgggggcgtggatgtcgccccggtcggtgcgcactccgcgtacggaaccgtcgggcgtccgcagcacggcggtgacactcgcgccggtcgccggccgggcccccgacgcccggaccaggtgggcggcggccagtgccggcatcacctgcgcgtcctgcggataccgcaccgcacccgcgaggcccggcgccaagtgcggttccagttcgcgcagttggtcggcggcggcgggactcacctcgaccccggcggccgactgccgggccgccagatccgtgagagcggtcagcgcctcgggcgtctcggcgacgaccagaccgcccttggcctcgtactcgacggcatggccgaaccccggccgccgttcgacgagttcggcccacaaccggcctgagagcaaggcgagttcgagttccggccccggttccttgtcggagacgagcagattgccctcgcccgcacccgtggtgccgcccgccaccggaccccggtccaccagggtcacgtccagacccgcccgggccgcgtagtaggcgcaggccgcgcccaccatgcctgccccgacgaccacaacatcgcaggtcagtggcgaagtcacgccagtactatgtcacacaccacacctgtcgccaagggtgtcgacgcccctccgggcagccgacggggacggggacccgccccagggcctgtcgccctagatccggctctcggtcgccgtgtccgcggacagccgctgggccacgtagatcgggagtacggagaggaggaccaggaccgccgccacgacgttcaccaccggtgcctgctgcggtcgcgtcatgttgttgaagatccagatcggcagggtctcgatgccgggaccggccgtgaacgtcgtcaccacgatctcgtcgaaggagagcgcgaaggcgagcagcccgcccgcgagcaacgccgagcgcaccagcgggaaggtgacgtcggcgaaggcgcggaaggtgttcgcacccaggtccatcgccgcctcctcgtacgagccggaggtgcggcgcagccgggcgacgacgttgttgaagacgacgacgatgcagaaggtggcgtggccgacgaccacggtgaacatgccgagtccgacgcccaggggctccaggaccgtactgaacgccgagttgagcgcgatgcccgtgacgatgccgggcagcgcgatcggcaggacgaccacgaaggagatggcgtcgcggccgaagaagcggtgccgggccaccgcgaaggcgatgagtgtgcccagcagcagggcgatggccgtggcgccgaggcccgccttgaccgacacccacaacgcggcgcgggcgccctcgctcccccaggcgaccgaccaccagtggagggtcaggcccgacggcggccagctcgcgctgcggtcggagttgaaggagttgacgaggacgagcgcgagcgggacgtagatggccgcgaagccgcatccggcggcgacgcgcaacgcgatgcgcgcggaacgggacagttgcacggcagggctcctaacgggctgatcagaggctgctgagcgcacccgtgcggcgcatcgcgagcagatagaccacgatgacgacgacggggaccgtgccgagtgcggcggccatgggcaggttcagttcgatgttggagtagacgaggttgccgatcagctgggtcttgccgccgacgatctgcacggtgatgtagtcaccgagactgagcgagaaggtgaagaccgagccggccgcgaccgacggcaggaccatcggcagcacgaccgagcggaaggtgcggccggcccgcgcgcccagatcggcggatgcgtcgaggaggttggcgggcagctgctccagcgccgtgtggatcggcaggatcatgtacggcagccagaggtacgtcagggtgatgaccgtcgccggcaggccgaaccccggaccgctgagcccgaacggcttcagcatccagtcggcgagcccgtcctgggagaggatgagccgccaggcgtacaccttgaccaggtagctggcccacagcggggtgaggatcgcgaccacgaggagcggacgccacttcggcttggccaggcgggccgtgtagaaggcgaccgggaaggcgatcaccgcgcacaggacggtgaccgcgagcgcgacgccgacgctgcgcaggatcacctggcggaagacgggggtggtgaacagcgtgtggaagttgtcggtcgaccagaccttcacgacctcggaggtgaaggagttcgtcgtccagaacgcggagatgaacagcacgctcagcgagccgagatagagcacggcgagccagagcagcggtgcggtcaggagcagggacagcctgagccgggggcggcggtgcagggtcccggcgagccgccggacgggggtccgtccggcggctcgcgcagtggtggtcttcaccgttgtctcagcccttgatctcggtccaggcctggacccacttggcgtagggcacgcacttcacgtcggtacggccgtcgaggcactgctcgatgggcgtgttccagaaggcggtgtccttccagtagctctcttcggtggcgtggaaggtgtcgcagaagttcttgtcgctggtctcgtcgcaggccttggcgttggccggagcctcaccgaagtactcggcgacctgggcgttgaccttcggtgagatgatccagtccagccacttgtaggcgcagttggggtgcttggccttggcggagaccatccaggtgtcggaccagccggtggagccctccttcggcacgaccgccttgaccttggcgccctcgtcggcggcgaggttggcgatgacctgccaggtggtgccgaccacggagtcgccgctcttgaaggcggagatctccttgaggtagtcgccccagtactcgccgacgttcgcgttctgcttcttcagcagggcgacggccgcgtcgaactgcttctggtcgagcgcgtaggggtccttgatcttcagttcgggcttggtggccttgagatagagcgccgcgtcggcgatgtagatcggggagtcgtacgccgtgacatgacccttgtaccgcgaggcgtcgtcgaagacggcggaccaggaggtcggggcgggcttcaccttctgcgtgttgtacatcagcaggttggcgccacggccgtgcgggatgccgtagggcgtgccgtcgacggagttccacgcctgcttcttcaggccgctgaagacgtcctggtagttgggaacgaggtccgtgttgacgggagccgcgtcaccggaggcgatgaggcgcagggaggcgtcgccggacgcggacacggcgtcgtactggccggtcttcatcagcttgaccatctcgtcggagctggccgcgaccttggagttgacctggcagccggactgcttctcgaagtcgctgacccagtcggtcttggggtcgttggagccgtcctcgacgtagccggcccaggcgacgaggttgacctggccctccgtcttgccgagcttcgactgcgccttgaggtcgggcgggttgaggcccgtcgacgaggacgagccgcccgagtcggacgatccacaggcggtggccgcgaggagcaccgcgacggcggcggtggcctggagggttcgggtgagacgcacgacgttctccatacgtgacgggggactgagcggtggggtcaacacgtgacggcaggggtgagcggtcgggtcaaccggcttcggggaccctgaaggtgtggccgcggtgccactggagggtgacccgggtgccgcgatacgcggcgacgtccgcggaggaggtctccaggttctgctggagggcggtgagccggccgcccgcgtccaggtccaccaggaaacgggtgacgtctccgagatagaccacctcgacgacggtgccagtggcggtggagtactgcgggtcgcccgcgtgggcggactccccaaggacccggatcttctcgggcctgatgctgtacgtgccgggggcgccgacgatccgctgtgccgactcgcccgacaggaggttcgaggtgccgacgaacgaggccacgaacggggtcgaggggcgctcgtagatctcggccggggtgccgacctgttcgatgcggccccggttgaagacggcgatgcggtcgctcatcgtcagggcctcctcctggtcgtgggtgacgaacacgaaggtgatgccgacctcgcgctggatcgccttgagttcgacctgcatctgctcgcgcagtttgaggtcgagggcgccgagcggttcgtcgagcagcagcacacgggggcggccgaccagggcgcgggcgagcgcgacccgctggcgctgaccgccggagagctgggatgggcgccgggtgccgaacgcttcgaggcgtacgtcggcgagtgccttgcgggcccgggcgagccgctcgaccctgggcaccttgcggaccttgaggccgtaggcgacgttctgttccacggtcatgtgcgggaacagggcgtagtcctggaagacggtgtgcacgtcccgttcgaagggggcgagcccggtgacctcctggcccgccagctctatccggccggcggtggggctctcgaagcccgcgatcatacgcaggacggtcgtcttgccggagccggacgggccgagcatcgagaagaactctccgtcggctatctccaggtcgacgccggtcacggcggcggtatcaccgaacaccttccgcagtccctgcagccggatcgcgcgtgcctccatgggcgggaacctttctggtgcactcttacgttaaacgaaaagatatgaagtcatagttcaaagctcaagacccccttagggtaaaggttgagtcaacgcacaaggtggtggccgtgaagcagcccgtcaacaggaacgccggcggcgcccggagcgccgtcttcaccccggtggacagccgggcacgagtggagacggtcgtccgccggctcggcgacgccatcgagctcgggctgctcgccgacggggagcagctgcccggcgagagcgagctggccgggcagctcggcgtgtccaccgtgaccctgcgggaagcgctcatggcgctgcggcagcaggggctcgtcaccacccgcaggggacgcggcggcggcagcttcgtctcgctgcccgcgatccccggcgaggagcggctcagggtgcggctggccggctggagcacggaggagctccgggacctgggcgaccactgggcggccgtgtcgggcgcggcggcccggctcgcggcgcagcgcacggagccggacgacctccagcaactgcgccgcacgctcgaggagttcgatcaggccgaggacgcggcggcgcgcagccgcgtctacggccggttccatgtggagttggccgcggccgcgcagtccgcccggctcacccgcgagcaggtcgcgctgcagacggaggtcggggcgctgctgtgtctcgtactcggggacgacgcctaccgtcaggaagtcgccggccgtcaccgcgccgtgatctcggcggtgcaggatggggccgacgacacggccagagcactggccgagcggtgtgtacaggactccacggcgcggctcatcacgctgcgcctcgccctgtagcagcgtcgaacccggtccccgtgcgctggagggcgcccatgagcaggagtcccggtccggccggtgcggcggcgacgctggatgtgtcgccgcaggcgcgggtggcggcgcaggcgcgggtggcggcgcaggtgcgttccgcgctggaggcggtgttcgaggccgtcgaggagacgcgggcggacacggcggcgttgctggcgcaagtggccgggctgggtcgtcggccggcgaccgtggatctggccgggctgcggccggggcttcatctgcggctggcgcggcaggagctggtctcgggggtggggttcgtggccgcgccggggctgctgggcgatgtgccgacgtggctggagtggtggcagaccggtgcggacggggcgctgcggccgttgctgctcgacctggacccgcggcagtcggcgtactcggattacacgcactgggactggttcgcgctgccccgtgacaccgggcgccgggcggtggccgggccgtatgtggactatctgtgttccgaggagtacagcctcaccctgtccgcgccggtgcaggtggaggggcggttcgcgggggtggccgcggcggatgtgtatctgcggcacttcgagacggccgtgatgcccctgctgcaacggctgccgggcccggcgcacctggtcaacgcgcgcggccgggtcgccgcgtccgccgaccccgcacacctggccggctccctcaccaagggccccgacttcgccgccgtcctcacccaggcccggccggaacacttcgacggcctgcacctgatgccctgcgacggcgtccccctcgtcctcgtcatggccgagcggtgagctccggcgccgtcggcgacctgaacgccgacggagccggagtctcgaaccgcctcacctctccggtgagggcaccacgctgagatggttcgacgtgcggcccgcgcgacgcggcctgcgagggccgtccgccgggcggcgcgcctcgcgcagcaccagcgtcatcctcgtatagcccatgtcctgaagggtcctcggggtctcccccaccacccggcagtcggtgccccagcgcggatcggggtgcagcagcgggcgtacggcaccgtcgtgctcgacggcgttcgcccccaccgcgcggatccagtgcggcaggccgtgacggtaggcggcttccatgatcgggtcctgggcgatgtcccggcggatggacagcagacctcggtcctggccgtggcgctccaccgcggcggcgaagtgcgccagcatcggcaggcaccagctcgactcgtgctcgccgaggatcgtggccgcgtccgggtggaacagcacgaaccggaggaagttgtcgcccggcatggccgtcgggtgcggccccacgccgccgaaaagtgtctcgaacgcggcgttggacaggacgacgtcccagcggtggtcgaagaccacggacgggaaggagacggattcgaggagcgcggcgtagtcctgcagatacgcctgagcctccacactcgcggggacgggtcgcggcgccggccgctgcccacctgcctgatacgccatcgggaggtcacccctcttgcccttgcggccttcacgcggcgccctgatcctgcttcccggagcagagtcatgtcaactatcgtggcatttggcgcgcgttgacggctgaatctcgccacagttgtggcgagacctggatgtgagttcgaaccaaccgctaatctcccgatggttcctgaccatcaccggatggtgccggatcagcatgagagccgtgtgagagacctgagaagagacgtaggagatctgtcggtgacggatggcctggaagttccggacgccacggcgacggttctgctgccggccgtcgtggcccgtgtcgcagccctggccgaccggctgggcgtggcgcacgcggaggtcttcgacgtcggccgcctctcggtcgcctcgggcgtcccggagcccgtggtgaaggccctgctgagcgggcgccccgccggtgagccggatcttcaggcccgtttcctccagcggctcgacctgctgcgccgcacccggctcaagcccaacaggcgccggtacacccagcaggagatcgccgacggcgcgggcatgtcgcgccagcaggcgggggccctcatcaacggggaccgccgccccaccatggagcactgcgacgccattcagcgcttctttagggtgcacgccggattcctcacggctgaggaccccgaggcgctcgcgggcaccctccagcgctccgagcaggagctcctccagcagctcgccgaccgggagcgcgcggcggccatggccgtcgacgacccgctggagcggctgttgcaggaccacggcgtccgcggaatcgcctggcgggccgcgcagctgcccaccgaccagcaccgcgacaaggtggcggagtggctcgacatgctcctggagagcgtcaagcggcccgagtcctgatccgggggagaactgtgggcatcggaagggaaatgcgccgcctgtgcggcgagttggtcgcggagctctcgctcccggcgccggcggagcccgccgacctctacgccgcgctgtgcgacggcatgagcagacgccgcggccgccccgtccagtaccgtacggccgcgttcccgcccgggaccgcgagcgggctgtggctcgacatggccgaccaggacctcgtcgtcatcgaggaacgcaccgctcccgaccaccagttggtgatcctcggccatgaactgtggcacatgaaggccgggcactgcagccaccacgtggagggcgccgccgtggcggcccgtctgctcagcgacaccgcggatcttcaggcgaccgtcctgaaggtcgccgcgcgaacccgcttcgaactctcggacgagaaggaggccgagagcttcggtctgctgctcgccagcaagtgccgcagatggctggccggttcgtcgctgcgggggcccgtgcgccgcgacgacgtggcgggccggatcgaggcgtcgctgggctatcgcgggccgcagggctgaagacgcttcgacatggacggatccagctactacataccggctgctgccatgggggtcgccctcgcggccaaggcacccgccttgatccgcggctggcgcgacccgctgttgcgttccgtgggcgtgctcctggctctggccggtctggtgttcctgttcgcggccccgccgacgatcgctgaggtcaacgccctcaccgggatcccgaacatctcggcaccgcttgtctactgtgtactgagtgccttcagcgcgtcctgcctggtgctgatcatcaactggcgcggcgggccgcccgaggtgacccgccgcctctctcgccgctggatcgccggatacagcgtggtgagcgtcgccctggtcgtgctgttcctcctcggggaggcccctcaggagcggctgcgggacctcgacacctattacgccaacacacctttcatccgcgagatgatcgtgctctatctcgccgcgctcacggtcgcgggtgtcgccatgaacgtgatgtgctggcgctgggcgatccaggtacgcggctggctgcgggccgggctgctggtcatcgcgttcggcttcatgttcaacatcccttacgcggcggccaagttcaccgccgtggtcgcccagtggaacggcggcaacctggactacctgagtaccgatgtggcccccgtactggcctcggcaggcgcacagataagtgcggtcggcttctgtctcccactggcctgccagcgtatcggggacaactggatcacgtggtcgacctaccgccggctcgggcccctgtggcgcgagttgaagccggtctcgaccttcgccgaccgtgcggtacgcatctcctggtggtcgtcggcagatctccaggtcacccagcgggagtcagacatccacgacggcatgctcggcctgtacccctacttcgattccgaggtccgctgcctcgcctacgacgcggccgtggccgcgggctccgagcccgcccaggcgcaggccgaggccgacgcggcgatggtgacggcggcggtgcgggcgaggtccgccgaccctgagggcagggtcatcagctcagcggaggcaaccgccccgttctcgtccttggacggtccacgcgacctcgtgcggatgtccaatgccctgcgtcagtcacccgtcgtcgcggccgcccgaaggcaggcctcgaccaggtcagagagcgacttccatgagcgaacccgctagcgtcccccggggcgcggcacctggcagccgcggcacggcctcccccagagccgtcgtcatcggcgcgggactggccggcatgctggccgccgccgccctgcaccgacacgccgaggtcaccgtcgtggaccgcgacgtcctgcctgcggagcccgcgccgcgcaaggggctcccgcaggcccgccacgctcatctgctgtggtccggcggcgcccgcgcgatggaggacctgctgcccggtgtgaccgccgcctggctggccgccggcgcccgccggatacccctcccgaccggcctcgtctcactgtcggcgcagggctggctccggcgctggcccgagatggagttcatgatctcgtgcacccgcgacctgctcgactcggtcatccgtgaacaggttgccaaaaaggagggggtcaccctcttggcgggcaccgaactgctcggtctggagggcggggccttgcgggtgacgggagtacgggtgcggacgcccgagggcgaggagcgcgtcctggaggccgatctggtggtggacgcctcggggcgcggttcgcgctccgtcgcctggctggacgcactgggcgtgccacaggctccgatggacgaggtcgactccggactcgcgtacgccagccggatcttccgggcacccgcaggcaccgaggactttcccgtggtcaacgtgcagccggatccggcacagcccgtacccgcgcagtctgcgacgatcgttcccgtcgagggcgggcgctggctggtgacgctgtcgggcacccacggcggccagccgacggcctccgccgaggagttcgaggcgttcgcccgcggcgtcagagaccccgtcgtgggcgaactgatcgcgcacgcggagccgctgacgaacgtcgtactcactcgcagcaccatcaaccggcggcgcttcttcgagaaggtgaaggactggcccgagggattcgtcgcgatcggcgacgccgtcgccacgtacaacccggtctacgggcacggcatgtcagttgccgcccagggcgcggtggcgctgcgcgagcacgtggccgagcacggactcgcggcccccggactcgcgcgccgggcgcaacgtgccgtggcccttccggtgaagatcgcctgggagctggccacgggcacggacatccgctaccccgaggcgatcggcaagcagcccgggggcacgcagaagctcctgggccgctacgtggagcggctcatgcggaccgcgacgggccggccgctggtcgcccaggcgttcctcggcgtgatcacgctttcgaggccgctctccacgctcgtcaagcccgaggtcctcttcgcagtactgcgcggcccgcggcgctctcccctggccgggccgccgctcacacctgaggagcgcaaggcggtgctgaccgcgaaggagccgtcgggcacgcaggctgccggctgacgtctccctggacctggagggatgacgggcgcgtcagcctccgggtcctggaacccaccggcatcacgtcgcgctgcgttcgctcgcctgcctcaagtcccgttccaccgcccggttccgcacggtgtcgggccggccggccgcgctgcccgggcggccggcccgcagcagttcgcgccagtgttcgcggctccagtgggcgggacgggtggtgcccgtgaactcctcgaccagggcgaggaagcgcgcggggtcagtgtggaaggggaagtggcccgcgccctcgaagatctccagccggctgccgggcatcgcctcgtgcgcgccgtacgcgtgccgcaccggcaccacgctgtcccggtcgccccacagcagcagcgtgggcatgccctcggtcagatagcagcggtcgagcatggtcaccgcctgcccgcgccagtccacgacggcccgcagcgtacggatgaaggcactgcgcgaggtcacgtcgggcagtgcgtccaccagggtcagcaactccggcgcgtcctggcccagatcggtgtcgaggagcctcatcagccgtgcgaacatccccacttggaaccgcatgccgggcaaccgcagagtggagagcatcagatgcgcgccgggcagtgagacggcccgcagcaccgggttgacctcccgtcccactcccccggcgctgaccaggatcagccgctcggtccgctccgggaactggtacgcgaactgcatcgcgaccccgccgccgagcgaatgcccgaccagcgtggccgactcgatgtcgagcgaggcgagcagatcgcgcaccccgttcgcgtacgcggccaccgagtagtcggcccgcggcttgtccgaggcgccgtggccgaggaggtccggcgcgatgaccgtatgggtgcgggcgaggtcggggatcagctcggcccaggtcgccgaggagtccccgatgccgtggatgagcacgagtacgggaccctcgccggccatgcggtaggcgcggcggtagccgtgcacgacgcggtggtgcagccggagttcgccgtcgcccaccgggcgcagccgcagtgcgcgccgcgggcgcggtggtgggacgtcgaccatggctcgcctcccgttccccaggccgccgcggaagcggccgtaggcccttcctttcagcgtagggcccctgccccacaagggatttcggggatgtttcgcctccgctaagcgggcgaacctcggcgtacggaaacgggattgtcagtggtggacggcaagctggacgtgtgccaccggtgtgcccgggggcgcacgcagttcacgtaccgcacgacgaagccgaccaaggggagagccgaccgatgccgacagccgtactgaccgaccgcgaacgcgccgccgtgcaggcctatctccgcctcctccagaccgtacgagcgacgttcgacggtccgccggacggccgccgaccacccgcggtccccaccgccgcactggcggaggcggagcaggccctgtccgccgcgggcctcgcgggcaacgaggaggagttcttccacctgctgcgcagttggtgcccggaggggtagggcctctcccagtggtgccacacaggccggtgtgcgcaagggtcagtggtgcggcaccgtgacagccgtcgccaccaggccccgccggaccgtccagcggccgtcgaaggcgtcgagccgccggccgttcaccagggggccggggacgaggagttcggcgcggaatccgccggacagggccttgccctgtgcggcgggctccgtgaagatctcgatgtccgcctcgaggaagtccagccacttgccggtgagggggaaccacgccttgtagacggactccttcgcgctgaacagcagccggtcccagtggacgtccggacgggaccggccgaggtcgtacaggcggcgctcctccgtcggcagggcgacggaggagaggactccctccggcagtcggtcgtggggttccgcgtcgatgcccagactggccagctcaccggcgcggaccagcacggcggcgcagtacccctcgcagtgcgtcatgctgccgaccagcccggccggccaccgcggggcgccgcgctccccgggcagcaccggctgcgggggcacgccgagcttctccatggcgcgccgggcacaaacgcgtacggcggtgaactcgcggcggcgcttctcgacggcccgcgctatgaccgcctgctcctcggggtacagcgccccgtccaccgccgcctcgtcaccgtgggcctccacggccacgaccgccgccgggagcagctcctcgatcaccgggcttcgacctccatcggcagaatgcggcgcagcgtgcccggcggtgtctgccgcctgcgccattcgcgggggtagcccacggacacctcttcgaagcggacgccctcgtggtgggtggtccgcggaatgtggagatggccgtagaccatcacctcggcccggaatctgcggtgccagtcggcggtcagccgggtgccgcaccacatggcgaactccgggtagtgcaggacctccgtggggtgccggtccagcgggtagtggttgaccagcacggtggacagctcggggggcagctgcgccagcctgcgctcggtctcggcgatccgggcccggcaccaggcgtcgcgggtcgggtaggggtcggggtgcagcatgaactcgtcggtgcagacgaccccggtcccgtgggcgtactccagcccctgctccttggtgtcgcagcccgccggcaggaaggagtagtcgtagagcaggaacagtggtgcgacggccaccgggccgcccggcccctcccagacggggtacgggtcctcgggcgtcgtcacacccagctcacggcacaggtcgacgaggtgctcgtagcgggcgaggccgcgcagggtgacggtgtccttggggtgggtccacagctcgtggttgccgggtgcccagatcaccttgcggaagcgtccggccagcgtttcgagggcccagcggatgtcggccacggtctccgcgacatcaccggcgaccagcagccagtcgtcgtccgactcggggcgcatcttctcgacgagggcgcggttctccgcgtatccgatgtgcagatcgctgatggcgagcagctgtccacgaccggccgtcgactccacgctcgcccccttcatgaaccggttccccgagaaacgatctaccagaaccgatcttcatcaacccggacgtgaaacacaagaacacatccgcgcgcgcccggacaagggcacgccggggcacgtcaccacgagcgctcggatcactcgagcacggctgccgtgaatccgtaacacgcgtgtagcagtgagggggtcccggagggcctatgatcgccccaacatacatccgtctccgacgctctcttgcgtacggcggtttggtgtacctccctactcccctggccgggcccggcctgcttcgccgtgcccgcaaaccgtgaaaggtggcttgcatgggctctcgcgtacgcgtctggctcaaccgcacgtacgcggagaacgtgttcttcatggatcagctgcggcgaaatccgcacgaccgggcggtcgagatccatgccacgcacgctgacgccgactcacccgtcctggccgcggcggacacctccgccatggaacccgagggcctgtccccggcgggctacgtcgagtacgccctcgaccagtgcgcgcgccgcggcatcgacgtgttcgtgccgcgtctgcaccaggacgcggtcgtcgcgcatcgcgcggacttcgccgcggccggtacggccctgctggcgccgcccgccgaggccgtggccgtcttccaggacaaggcgacggcgtacgaggcggtgcaggcgatcggcattccggtgccgccgtggcggcgggtgcggaccgaggacgaactcctgtccgctgtcgaggagttggaggcgggcggatacaaggcgtgcttcaagccggcggccggcgcgggcggcgtgggtttccgcatcatcacgcgcacccccttctcgctcgcacacctcaacggcttccccggcccctatgtgcagctggacctggtcatccaggccgtgcgcgacgccgatgagccggtggactggctggtcatgccgcacctcgggcagccggaggtgtccgtggactgcctcaccgggcccgacaaccggatccggatggcggtgggccgcacgaagaacggccgccgccggggcttcacgctccacgagcagtggatcgatcccgccacccggctcgcggagggcttcgggctgcactacctctccaacatccagttccggatgttcggcgacaagccggtcctgatggacgtcaacacgcgcccggccggcggcctgcaccagctctcgctgtgcggtctcaacgccccttgggcggcagtgcagttggcgctgggcgaggacccgggcgaggtggctccgccgttcctgggcacggactacacggtcgtgtcgggaccgcgcccgctgcgggcggtctcgctcccccagcagcgcacggaggagccggagaccgtgctgccggccgtgcccgcaccggccgcgaagcctgtctccgcaccgccggcggaagcgggggcacccgccaccgcgccggcctagaacatcgccttaccggtctggaccaatcatggcgcagcatcttgacaccgtgattggtccataccaacttggttgcgcactcttcggcactcccgcacccccatcaccttcagggagatcgcgtgcgcatcacgatgttcagacgctccagacgttccctcctcgccctgctgggctccgccgccctggctctggccggggcggtcgccctccccggcacggcccaggcggccaacatcctgtccaatcccggcttcgagtcgggcagcctgtccccctggtcctgcacgggaaatctggggtcggtcgtctccagtcccgtgcacggcggctccaagtcccttgcgggagccgtgagttcgagtgacaccgcacagtgcagccagaccgtcccggtgcagccgaacacgacgtacagcctgtcgggctgggtgcgcggcagctatgtgtacctcggcgtggacggcggcgcctcgacctggacgacgtccacgtcggcgtacagccggctgtcggtctccttcaccaccggcgcctcgcagaccagcgccaagatctatgtccacggctggtacgcgcagggcacctactacgccgacgacatcagcctggacggtccgggcggaggcggctcggacacccaggcgccgacggctccgggcagcctccgctccaccggcaagacctcgtcgagcgcgaccctggcgtggaacgcctcgacggacaacgtgggcgtcacgacgtacgacgtctacagcggctccaaccaggtgctgagcgtctccggtacgaccgccacggtcagcgggctgtcgccgagcacggcgtacacgttcactgtgaaggcgcgggacgcggccgggaacacctcggcggcctccaactccgtgtccgtcacgacggacgcgggcagcggcggcggcaccggcttcaagcaggccgcgccctatctctacctcggctggggcgatccgccgagcgcgacctcggtgatgagctcgaccggcatcaagtggtacacgatggcgttcatgctggactccggcggctgcaaccccgcctgggacggcagccggccgctgaccggcggcaacgaccagagtgtcatcaactcggtccgctccgcgggcggtgacgtcgtcccgtcgttcggcggctggtcgggcagcaagctcggcgccaactgctcctcggcgagcgcgctggccggggcgctgcagaaggtgatcgacgcctatggcctcaaggcgatcgacatggacatcgagaacacggacgagttcgagaacgccaccgtccaggaccgcatcctgaccgcgctgaagacggtcaaggccaacaatccgggcctgcgcacgatcgtcaccttcggcaccacgacgaccggccccacctactggggcaaccgcctcatcgagcaggcccaggccctgaacgccggcatcgacgtcttcacgataatgccgttcgacttcggcggcggctccgacatgtacggcaacacggtgaacgcgaccgacggtctgaaggccaagctcaagtcgacgttcggctgggacgacgccaccgcgtactcccacatcggcatctccggcatgaacggcctgtccgaccagcaggagaacacgtcgccggcgacctggacccagatccgcgactgggccaactcgcaccacatcgcccgcctcgccttctggtcggtcaaccgcgaccggccgtgccccggcgggggcgtggtgagcaactgctccggcatcagccagaacacctggcagttcacctcgatcacggccggtttcaccggctgagtctcagcgtgggggtgccccgacgggggcacccccacgcgttcgtcagaagcggcccggcccgcggtacagctccagctcgccgtccagttcgacggccagcaccgtggcgtgcgggtcgaggtcggccgcggccggcggttcgatccagagcacgcccggtgcctcgtgcagcccgccgatgacccggtgggccagctcggtcccgctgccgagcaccgtgacccggcgcaccgtgcccgccatgccgcgtacgccgatctcggcgcgcggtgcgtcgaagagggtcagatacagcgtgcggcggtccgccgagagggtgctcggcccgtagtggtggcccgcgggcagtccgcgcacggtcccgtagacggcctccgcgtgcttggcgatccagtcgccgaggccctcgaggcgctcgacctgttcggccgggatggtgccgtcctccttcggaccgacgtcgaggagcagattgccgccgccgccgatcgtctcggtgaagtagcggatcagctgggtgaccgatttgtggttgtggtcgtggtgctggaagccccaggagtcgttgatcgtcaggcacagctcccaggggccctggggcggcacgacgggagcgccctgctcgggggtcgcgtagtcgccctcgctgagcatgcgggcgttgaagacgacgtccggcacctcggagcggatgagcgcggcgagttcggggatgcgccactgctcctcactgcggtcccactcgccgtcgaaccacatgaggtcgggcttgtagcggctggtgagttcgcggatctggccgtctcggtaggcgatgaaccgctcccaggcggccaggtcctcgtactcggcggcgacctcggagtagcggttgtccgccagctccggcgggcgtcccggcttgcgcgtggaggcgtagtcggggtggttccagtccgagtgcgagtagtagaggccgaccttgaggccccgctcgcgcagtgcgtcggcgtagccggatatcaggtcccggccgacgttcaggttgccgtgggcggtgtcccacagggcgacgccgtcgtggtggcggctggtcaggaccgcgtacctggcgccggcacgggcgaacagcgccgcccagtcgcgcgggtcgtagcgggcggcggtgaagcggtcgaactgggacatgtactggtcgtgcggcacgatgtcgtcgtagaacgaccacgattcctggacgccgtcgacggcgtagacgccccagtggacgaagatccccaacttggcgtcggtgaaccacggctgcatggacacggctgaactcctcggcagtacggggtcacttcgggggcgacagagggcggtggcgggcggcgggcgggcacggggatgcccgtgcccgcccgccgcgagaggcgccctactgggcggtcgcggcgcgcttcagacggagcgtcagtacctggaagggccgcagttccacggcgaccgcgccgtcaccgtcgacgaccgcgtcgccggccccctcggcgagcggtcgctccagcaggtcggtgacgtggacgcccgcgagcgggaagccggtgcgcagggtgccccgggaccggccgccgcccgactcgtagaggcgcacgacgacatcgcccgaggcgtcgtcggcgagcttgaccgcttcgacggtgaggccggcgccgtcgacggacacgaccggctccggcgctccctgggcgtccgcgacccgcagcggcaggttgagggcgtagccctccgcgaccgcgtcctcgatgctcgcgccgggcagcagcgcgtaggtgaagcggtgccggccctggtcggcctcggggtccggcacgcgcggggcgcggaccaggctgaggcggaccgtggtggtcgtgccgccgtcctcgcggaccgtgcgggagacgtcgtggccgtaggtggagtcgttgatcacggcgacgccgtagccgggttcgccgatgtgcacccagcgatggccgtagacctcgaagcgggccgcctcccagctggtattggtgtgggtggggcgctggacgtggccgaactggatctcggcggacgagtgcggggcgcgcaggtccaccgggaacgcggccttgaggatcttctcggcctcgtgccagtcgatctccgtctcgacgtcgatgcggcggctgccggcccgtacggtgatcgtctgggtgatcttcgaacccttgccgaaggagcgctccacccggatcgcgccgatcagcgggtcctgttcgacgaccgtgacggagtcggcgtccagcaggtccgtgtagcggttcttgtagtgcttgtcgatgtcccaggcgtcccagtagttcgggaggtcggtgtgcagccggagcaggttgccctggtcggcgaggacttcgcggtccgccgtcagatcccttacggaggcgagggttccgtcctcggcgacctcgacgcggaccaggccgttgtcgaggacgcggccggtgaccgtcaccggccgcgggggtgcggcgccgtcgaggggagcgctgccgcccgccggtacctccacgtacgccggggccccggtggacgtacggaccacctcggcgcggtcgcgggggctcgtgttgaagacgcgcggaccgccgccgccgagcgcggccaccgcctcggccgtcagctcctccagttccgtggccacccgggcgtattcggcctcggcctcccggtgcacccaggcgatcgacgagcccggcaggatgtcgtggaactggtggagcaggaccgtcttccacaggcggtccagcttctcgtacgggtaggcgtagcccggcgcgtgcagggcggccgtcgtcgcccacaactcggcctcgcgcagcttgtgttcgctgcggcggttgccctgcttggtgcgggcctgggaggtgtaggtggcgcggtgcagctccaggtagagctcgccgacccagaccggggcgtccgggtactcctcgcgggcggccttgaagaacgcgtcgggatgttcgacgacgaccttcggcgagccctccaggtccgccagcctgcgcgcccgttccatgatctcgcgggtggggccgccaccgccgtcgccccagccgaacggtgccagggagcgcgtaccgcggcccttgtccgcgtagttgcggaccgtgcgggacatctcctcgccgctgaagcgggcgttgtaggtgtcgatcggcgggaagtgcgtgaagatgcgggtgccgtcgatgccctcccaccagaaggtgtggtggggcagcttgttggtctggttccaggagagcttctgggtcaggaaccactcgttgccggcgagcttggcgagctgcgggtaggaggcgttgtagccgaaggagtccggcagccacacgcccttggtctcgacgccgaagtgctcgatgaagaaccgtttgccgtggatcagctggcgggccagcgcctcgccgccgggcaggttgccgtcggcctcgacccacatgccgccgaccggcgcccactggcccttcttcaccgactcctggatgcgggcccacacgtgcgggtagttgtcgcgcacccactcgtactgctgggcctgcgagcaggcgaagatgaagtcgtcgtactcgtcggcgagcgaggtgacgttggagaaggtgcgggacgtcttccgcttggtctcgcggatcggccacagccaggcggagtcgatgtgcgcgtggccgacgccggagagggtgtgggcgctggcgtgcgcgggcctcgcgagggccggggccaggacctcgcggacggccgtcgcgctgccggagatgtcgtccaggtccagcgcgtccagggcccggtccagggtgtgcatgatctcgtgccggcgcgggtcgtgctcgcccagctccagcatcagctcgcgcagcacctggacgtccagatcgaggtgccagacctcctcgtcgaggatggcgaggtcggcgcggcggaaggtgtagagcggcttgtcgcccgcggtgaggacgtcgccgagcggggtcgggcgcgcgaagtcgcctgcgaggatgtcggggttggaggccgcctcgaccaggtagtcgatctcctcgccgcccgtggccgggttgccgatcggcacgtactggttgagcgggttgaccgccttgagcggggtgccgtcggtgcggtggaccagcgcctcggcctggttgccgggccagtcgccggtgaagccgaggtcgatgaccgcctcgacgcgccgcccggcccattcggcgggcacccggccgcgcatccggaaccaggtggtgccccagggcggcccccacggggtgtccatggcgaacggcgcgtacgaggcggccgcggcctcctcgaagggaacgggctcgcccggcgcctgccaggcctcgacggcgaaggggacggcggccgcgtagaccgcgggcttgatgcgctggttgtggatgcgctctacgcgctcctcgatccggcggcgttcgtcgtgcatgaaagtctccaggaagatccaggaatatccgggaagcaggaagatccagaaagatggaaagcgcttacttaaggtacgtcagacctgggtggaccgaggtgtatccgtcgaccagcctgcgggccacgttcacggagtccacgagggggtgcagcgcgaaggccttcacggccgtcgcacgggagccggactcggccgcggacagcacctcgcgctcgaccgccttcaccgcgcacaccaggcccgtggcgtggccggggagcgggtcgacggcgaccgggtgcgcgccattggcgtcgacgaggcacgggacttcgatgacggcctcggcgtcgaggaccgtgagcgcgccgcgattgcggacgttgaggatcagcgtcgtgcgctcgtcccgggcgatggcccgcatcagggcgagggccaccttctcgtagccgccggagaggtcgtcggcgtcgcgctcgccggcgcccgccgcgtcgcggttctcggccatgtacgtggcctcgcgctcggcacgggtgcggtcccaggccgacagggcggaggagtccgcccgcttcatctcctcgtagaaccgcgcctgctggtcgcgcaggaaggcgccccgggtcttctcggcctcgctgtaggcgcgtacggcttcccggttgaagtagtagtagtgcaggtactcgttagggatcgcgcccagcgaccggagccagtcggggccgaagagcttgccctcctcgaaggagccgagcagtccggggtcggcgagcaggcgcgggagttcgtcgcggcccgcgacgcgcagaccgcgtacccagccgaggtggttgaggccgacgtagtcgatgaaggcctcgcgcgggtcggcgccgagcacgcgggcgatgcgccggccgaggccgaccggcgagtcgcagatgccgatgacacggtcgccgaggtggcgtgacatggcctcggtgaccaggcccgccgggttggtgaagttgatgacccaggcgtcgggggcgagccgggccacgcgccgcgcgatgtcgacggcgaccgggaccgtgcgcagtccgtacgcgatgccgcccgcgccgaccgtctcctggcccagcacaccctccgccagcgccacccgctcgtcgtcggcgcgcccctccagtcccccgacgcggatcgcggagaagacgaagtcggcgccgcgcagggcctcgtccaggtcggtggtgaagctcacctcgggcgcgtccggatccccggcggcctgttcggcgagcacgcgggccacggccgtgagccgccccgcgtccaggtcgtgcagcacgacccgggtgacgcggccctcggcgcggtccccgaggagcgccccgtacacgagcggcacccggaacccgccaccgcccagaatcgtcagcttcacgcttgcacctttcctgccacgatcacctcgacgcccgcttcctccagggaggaccgcgtcgccgcgtccaccggcccgtccgtcaccaccgcgtccaggtcctcgggcccgcagaccctggccatccccgtgccggggaacttcgccgagtcggcgagcaggacgacccgctcacccgcccggatcatggcccgcttgaccggcacctcgacgaccgtcgtgtccatcacctgcccgccgggccgcactccactggtgccgaggaagagccagtcggcgtgcagctgacgcagattgtcctcggtgaggaagcccaccagggagcggtactcgcggcggaccatgccgccgagcagcaccagctcgatgccctcgtcgtccgcgagctcctcgtagaccaccaggttgctggtgatcacggtgagccggcggccgtgcagctgccgggccagccggtaggcggtggtgccgatgtcgagcagcaccgactgaccgtcggcgaccatggccgcggcgtgcacggctatggcgtccttctcggccacccgcatctcggcgacctcggcgaagggctggtcgccctcctccaccacggcgccgccgtgcacccgggtgagcaggccctcctcctcgagtctgagcaggtcacgccggacggtggcggggctcacgcccagctgctccgaaaggtcggtcacggccgcggggccgccggagcgcagggcccgcaggatgagttgatgtcgtcgctctgccagcacgcgatgaacagtactcgtcatcttcgatcatttctatgctcagttctgctcgactcttgccaaattctcgagagacgcgcacgatcctgtgcaccgcttgcagacttttgacgagaggatgcgcccgtgggcgacgaacggcccgatgtcctgctgaccgggctgctcttctacgacctcgtcctcaccgggctgggcaagccgccgacacccggtgaggagatctggaccgagggcatgggcgtgagccccggcggtatcgccaacctggccgtggccgcctcccgtttcggcctgcgcacctcgctggccacggtcttcggcgacgaccactacggcgcgtactgccggggtgtgctcgccggccaggagggcatcgacctctcgctctcccgtaccgcggacggctggcacaccccggtcaccgtctccctcgcgtacggccacgaccgcgcgctggtcacccacggccaggaccctccgtactcgcaggacgcgctgatgggcgacccgcccgaggcgcgcaccgccctcgtgcacatcgaggccgagccgcacgcctggctcgcaaaggccgccgcgaacggcacccggatctacgcggacgtcggctgggatcccacccagcagtggtcccgcgacctcctcgaccagctctccctgtgccacgccttcctccccaacgaggccgaggcgatggcgtacacccgcaccgacagcgcgatggccgcgctcggcacgctcaccgacctggtgccggtcgccgtggtcacgcgcggcggggacggcgcggtcgcggtggaccagacgacgggcgagtacgccgaggtacccgccctcgacatcgatgtcctggacccgacgggcgccggggacgtcttcggcgcgagcttcgtcgcggcctcgctcggcggctggcccctggcggagcggctgcgcttcgcggtcctcgccgccggactctcggtacagcggcacggcggtgcgctggccgcgcccggctggtacggcgtccaccgctggtggcactcgctcgaagaccccggactgcggcgcgcgtacggcttcctggccgaccggatcccagcggacccggggccgcccgtccggcacgcgcccgtgactccccccgatgccacgcgtcgcccgagcacctcccgatgaccccacgtgtgacaccccgtatgaccccacgcatgactcctcgtacgcgaagaccgaaaagatccgaaaggcggtgggagcagtgcggctctcacgaagaggcctgctgcgcgcgggcctggccggtacggccgccaccgcgctcggcggcctggcgaccggctgtgccgtcccgaccggttccaccggccggaacatggtgctgtggtactggagcggcgggctgagccccaaagtcgtccaggacgccaaggcccgctacgacagcgcggtgaacctacaggccatccagatcggcggctactaccgctcgaagctgatgaccacgatgaccgggcgcgcccacatcccggacatcgtcgggctcaagggcgaggacatggcctcgtacctgccgaactccgaccagttcgtggacctgcgcgcgctcggcgccgacaggctcaaggaccggtatctgccctggaagtgggacgagggcatcgccgaggacggctcgatggtgggcttccccatcgactgcggtccggtcgcgcactactaccagccggccgtcttcgagaaggcgggactgccgtacgagccggcggacgtctccaaggagctggacacctgggagaagttcctcgcggccggtgagcggctcaagaagcgcgtcccgggtgcgttcatcctcacggacgccctcagcatctacggcatgtcggtcaaccagacgaccaagcggttcgtcgacagggaccggcacttcatcggcgaccaggagcatgtgcgcaccgcctgggaccgggctgtcgaggccacccgccgaggcctggtctcgaagatcatcaacgggacgccggacaacatctcggccaccgagcggggcctgctgcccagccaactgaacgcctcctgggcggccggcgacatcaagctcaacacgccgaagaccaagggcaagtggcgggtggcgagctgtccgggcggcccttcgaacatcggcggctcgttcctggcgatcaccaaggcgtgccgggagccggagaaggccttcgagatgatcacctggatgctcgacgcgggcaaccaggcccagggattcgtcgactcggtgctcttcccgtccactccggcgtcgtacggcatgaagaagctgcgcgaacccgacgcgttcttcggcggccagatcaccatggacgtcttcggcccggcggcggagaagatcccggtcgccttcaacagcccgtacgacatcgcgctcaagaccccgatcgacgacgagctgcggaacttctccgtcctcggcaaggacccggagaaggcctggaaggacgccatgagcaagtgccggcgcatcgccgaccatctgggggtgagctactgacatggctaccgcacccgtggtcgagacctccccggcggtcgtgtccgccaccccaaccgcccgctccgggaagggcgtcctgagccactggcggctgtacgccgcgatctcccccttctatctgctcttcctcgccttcggtctgataccggtcggcttctcgctctacctgtcgttccaccgctgggacgggctcggctcgatggagttcgcggggctctcgcagtaccgctatctgctgtcggacagccagttctggacctcgatcgggaacacgatcgtcatctgggcgctggccaccatcccgatgatcctcctggcgatggtcacggcggtgctgctcaactccgcggtccgcttcaagaacgtctaccgcttcgccttcttcctgccgaacgtcacctcgatcgtggccgtcgcgatcatcttcggctcggtcttctccaccaacttcggcctgatgaacgccgtgttgcaggcggtcggacttgaccaggtggcatggctgaacactccctggggcatcaaggtcgccatcgcgaccctcatgacctggcagtggaccggctacaacgcgatcatcttcctcgccggtctccagacgatcccgggcgagctgtacgaggcggcgcggatggacggcgccgggcccctgcagacgttcttccgcatcacgctgccgctgctgcgtccggtgctgctcttcgtgctggtcatctcgaccgtcaccggactccagagcttctccgaaccgcaggtgctgttgcagaccacggacaacaactcgtcgttcgcgggcggcccgggccacgcgggccagaccatggtcctctacttcttccagcagaccttcgacaacaacgacttcggctacggcgccgcggtggcctggggcatcttcctcgtcgtcgtcctcttctcgatcatcaactggcgcctggtgcagcgccggggcgaagaataggaggccgccaccatggcatccatcaagggttcacggcagcggggcatcgcgctccatctggtcctcgtcatcggcctgctgctctcggtcttcccgttctactgggccgtgatcatgtcgacgcactcgtcgaccgagatcttctcctacccgccgaagctgctgcccggctcgcacttcctcgagaacgtccggcatctcttcgacaacgtcgacttcttcgggtcgatggccaactcgctgctcgtggccggctcggtgaccgtcctggtcctgttcctcgactcactggcggccttcgtcttcgccaagttccacttcccgggccgccgggtgctgttcgcgctgatgatggcgatcttcatggtgccggcgcagctccaggccatcccccagttcgtgatcatggcgaagctgggctggatcggctcgatgaccgcgctggtcgtcccggcggcggccaacgcgttcggcatcttctggatgcgccagtacatgcagagcgccatccacgacgaactgctcgacgcctcgaagctcgacggcgccggcttcctgcgccagtactggcacgtggcgctccccgtggtccgcccgggtctggcgttcctcggcatcttcaccttcatgggccagtggaacgactacgcctggccgctgatcgccctcaccaacccggacaacgtgaccctccaggtcgccctgtcccagctcaacggggtgcacggcacgaccgactacgggatggtcatgaccggcgcgctgctcgccctcgttccgctgctgatcgtgttcgcgatcggcgccaggcagatcatcgccgacctcggcaagggagccattcgctgatgtcccgcgatccgctgatcgcgctccgcccctgggagtcacccgaggtgacctcctgggggcggctgccgatgaacgccgtcgaccgccgcaccggggcgctcccgctggacggcgagtggcgcttccagctgctgcccacgcccggctcacccgtgaccgaagcgtggtcgtcacagcatgtccccggcgcctggaccgtgcagggcaccgacgacctgccgcagtacaccaacgtcacgatgccctggggagagttcccgcccgcctcgcccgccgcgaacccgacgggcgtgtacgagcgcgaggtggacgtcccggccgagtgggccggacgccgggtcgtgctccgggtgggcgccgcggagagcgtgctgctcgtccacgtgaacgggcggccgacgggcatctccaaggactcgcacctcgcggccgagttcgatctctcggacgtcgtacgtcccggggagcgggccaccgtacggctcaccgtggtgaagtggtcggacgcctcgcacctcgaggaccaggaccactggtggcacggcgggatcacccggtcggtgctgctgtacgcgaccgatccactgcatctcgcggacgtgaccgtgcgggcgcgcccggacggcgggctgcgggtcgactgccgggtgcggcacgccatgggccggctccccgggggctggtacgtcaccggggagctggcgggccacctcctcgcccaggacgccgagttcgaccggctgaacgcgcaggacgagcgggtctccgacttcctcggcgaggcccgcctcaccgcgctcgtgcgcgaggtgcgcccctggaccgccgagacgcccgagctgtacgagctgacggtgcgcctgcaccgcgccgacggctcggtcgccgacaccgcgcacccgcgcgtcggcttccgccaggtcgagatccgcggccgggacctcctggtgaacggcgagcgggtctacatccggggcgtcaaccggcacgacttccatccgctgacgggccggacggtgtcgtacgacgacatgcgcgccgacctcgtcacgctcaagcggttcggcttcaacgcgatccgcaccgcgcactaccccaacgacccggctctgctcgacctcgccgacgagctgggcttctacgtcgtcgacgaggcggacatcgagtcgcacgaccacgcccacgagatcgccgacgacccgcgctacacggcggccttcgtggaccgcgtctcccgcatggtgctgcgcgacaagaaccacccctcggtcatcgtctggtcgctgggcaacgagtccgactacggcgcgaaccacgacgcggcggcgggctgggtccgccgccacgacccgacccgcccgctccagtacgagggcgcggccaagctcggctgggccgatccgacggtcgcctccgacatcgcctgcccgatgtacgcgccggtcgaggactgtgtcgcccacgcgctgtccggcgagcagaccaagccgctcatccagtgcgagtactcccacgccatgggcaacagcaacggcacgctggccgaccactgggccgccatcgagtccaccccgggtcttcagggcggtttcatctgggagttctgggaccacggcattctgcaacgcgtgaacgacggaagaccggccgggcgcgccggcgccgggctgtatgacaacggtgtcgcggcgcagggccaccgctgggcctacggcggcgacttcggcgagacggtccacgacggcgcgttcatcgccgacggggtcgtctttcccgaccgcacgcccaagccggtgatgtacgagcaccgggagatcgcggcgccggtgcggctcgcgtacgacggcggtgacctgcggatctccaaccaccagcacttccggggcctggagtggctggccgcctcgtgggagctgtcgctcgcggagggcggcacgctgaccgcgcccgccgggctgcccgacgtacgggcgggtgagtcggccgtggtgccgatgccgttcgccctgccggaggacggcggcgaggcctggctgacgctgcgggtgacgacggccgacgacgaggcgtgggcgccgcggggcacggaggtatgtgtgccgcgggtgcggctgcgggcggctgccccggtggcttccgcgccgctgacgacgggcgctcccgtccaggtcgacgaggacgggctgctcgtccatccgctgctcacggccgccccggtgctgtcgctgtggcgggcaccgaccgacaacgacgagatcggcggcatggcggcgcgctggcgggcctggggactcgacgcgctcgaacgcaaggtcgtcgatgtacgccgtgcggccggcagcgtcacggtggtcgccgagtacgggaccatggcgggtgccgtgcggcacgagcaggtgttcacgcgcgtcgagggcggggtgcgggtcgaggagacggccgagctgccggccgggctcgacgacgtggcacgcgtgggctcggtgttcgagaccgtcgcggggctcgatgtcctcgagtggtacgggcagggcccctgggagtcctatccggaccggagcgggggcgcccccgtcggccaccactcccgccccgtggacgagctgttcactccgtatctgcgtccgcaggagagcggcgggcggcacggtgtacgccggttcacgctctcggcgccggacgccacgggcttcgcggtcgagctggacgaaccgcgccaggtgaacgtgacccggtaccgggccgcggacctggccgccgccacccaccacgacgagctggtgccgcggcccggctgtgtggtgcacctcgacgtcgcgcaccgcggcctgggtacggcctcctgcggtcccgacacctcacccggccacctcgtcccgaccggcacacatcgctggtcctggacgctgcgcgtgctctgacctcgctggggcggcttcccgcgggccgcggcgaccgcggtcgcgctgcccgcgcggccgctcgtgacgcgcggtggcttccagtacgcggggaagaccgaccagattctgcacggccggctcggcgacgtacggatcgccgaacgcgcccttcccgtcaagtcgttgatgaaccactgacccgagggagccacacgaccatgaccgagcagcaactgcccgcctgggccgacccgtccgtctcccccgccgcgctggacccccagggcatgtcgcggcgcgggctgctgcgccgcgcgggcctgttcggcgcggccttcgcggtgggctcgctcgcgacacccgcggcggcctcttccggacgctacggcggcaacgatccgcggctcgcctacctcgtcggcgaccaccacatccactccgtctacagccacgacgcgaagtacaccttctcccaactcgcccgggccggcgaccggtacgggctcgactggatggtcttcaacgagcactccaacttcggacacgccgactacggcgcgaagctggagcaccaggagatcctgaaggcccgcgccgagaacccgcgccagctgatcttccagggccttgagtggtacatcccggccgccgagcacgccacggtcttcgcggcgcccggaccgcacgaggtggatctgctcacgcgcttcgagctcgcctacgacgggaagctgctcggctacacggacggcgccacctcgaacccgaacacggcccgcaacgaggcccacgccatcaaggccatccagtggctcgccgaacagcgccgcaccggctacgtcgacgacgtgctcgtcctcgccaaccacccgatgcgcctcggcatcgactccccgcacgagatgcggggctggcgcgacgcggcccccgagatcatgatcggcatggaaggcgcgcccggcgcgcagggcggtggcatacccggctgggtcggctcggggcagcagcgcggcgagtacgtcaacaagccgtccgcgaactcctggcccggctacccggaggacgcctacgtcctgtacggcggcttcgactggacgacggcgaccgtcggcggcctgtgggacgcgatgctcgccgagggcaagctgttcacgatcacgaccaactccgatgtgcaccgggtcgtcttcgacacctggaagaacggcgactgggcacccgggcggaacttcgacaacaccgggcacctccccgacccggtcaacaccgacagccagcagccgggcggcgacttctggcccggccagttcagccgcacccacgtgggcgtgacccgctacggctaccgcgcggtgatggcgggcctgcgcgcgggccgggtctggctcgaccacggccatctgctggacgggctcgacgtccgcctgaagcgggactgcgaccacggtccgggcgtgaccatgggcggccggctgcgcgtccgcaagggcgagaagctcacgctgagcgtcaccgtgacgaccgcgtcgcgccccaacccccacggcatcctgcccgagttggcccacgtcgacgtggtccggggcgcggtgcgcggcccggcggccgaccgcgacgactggcgggcgcccgacaccagggtcgtccacacgcgggacgtgagcggccgcaagggcacgtacaccctgcgcatcccgctggtcgcgggcgacgagtccttctacgtccggctgcgcggcagcgacggcaaccgcaacggtacgggctacctgggcgcctcggtcgacccgcatggcccgattccgcacgtgcccggcaacggtgacccgtgggtcgacacatggttctacgcgaaccccgtcttcgtcgatgtggtgggcggccgacaggagaaccgcccggcgtaggaaccgtcggacctagaagcgcgacaggctctgcaggacggcggcggggccgtacggtcgccggaatacggaaacggcccgtccccgcgctgcgacggggacggacggccggggggcggcacgcacggaccgcggagcgcgggggtgcggggtgcggggtgcggggtgcggctcagacggaccgcgggtcgcggttcagacgggcagccccgccagcatgcgtcggtccctgggcgcgtgctggcggtcgaggcgggcgtccagcagccgccgggcggcgtcgcaccggcctcctgccacgagggcgtacagcagtgtctcctcgacgacctcccgctgcgccgcgctgccgcccaccttgcggaggccgggcaggagcgcgtcgaggccgcgggccgcgtcgtggaagcgctcctcgacgagagcggcgaaggactcgcagagcgggacgatgatctcgcgctgcacctcgtccgccccggcggcgtggtcgcgcagccggcgcagggccgccaggtcaccggcggcggccagggcgaccgccgcgtgcagggcggtgaaggcggtcgcgggccgctcgacgacctcctgggcgacggtgccgaggacgtccgcggcgggtatccggccccgccaactgccgctcagccgggcccgccacagcagcgaacccgagtcgacgagcgcccgcaccccggtcacgcgccccggcgccagctgcgcgaaccaccgtttgcgtacggccgccgtgtcgtcgagggccagttcgtgcagcgcgacgtgccacgagaagtgggcccggtggaccgcgccccggccctggcccgagatccagccgtcgagccagtcccggccagtcgcgtgcgcgccggactcgtagtggacgtgggcgagcgcgtgcacggcgtgtccggcggcgggctcggcggccagcgcgcggtgcgccagctccccggcctcgccgtaccggccctcctcctggcggaggaaggcgagcagcgaggtggggaaccagtgcccgtcgtacaccggtgaggtgcgctcgaccagccgcagggcgtaggcgtcgtcgaggtcgttgatgccggagaaggcgatggtgggcacggcggtggcgagcgcgagcgcgtcggcggggtacgcctccaggtgccgcagcagggcgccgtcgccgtcgtcaccgtggatgcggcgggtgacgacgtcgacgaaggaccgctcccgctcgtcggcccgctcgcgcgcggagcgctgtgcgtcggcgagggcgcggggtacgtcgacctcggcgccgcactcgtggccgaccagggcgagggcggcgtgcccgagcgcgaagcccgggtcgagggtcaccgcgcgcccgaaggcgtcctcggctgcggccctgaccttgaggacccggtcgagcccggtgcggtaggcggcggccgcctcggcgtgggtggacagggcgagcccgtgcgcgtcgacgggccggcggcgcggtcggcgggcggcccgggccggccgggtgaggggcgcgagcaactcctgggccagcgcggccgcctggacccggatctcggggatggcggtggtctcccacagctcaccgcgccgcggagccccgagcgtgaacagcgggcgctcggcacggccccgcgcgtcgaggagacggccgtcaccggtggcgacccccatgccgagcggcccgggcacggcggcgccggagccgaagagcgagcgccacagggggtcgtcgaggcggggccccgggccggtgcagtcgacgacccaaccggcgcgtatccggcgaccgccggagagcgagacggtcaggatgccgcccggacggaagtgggccggtacgccgcccggcccggaacgggccgccgcaccttcatccccggccccgaccacacctgcaccctcacccacacccacacccacacccacgatccgcccggcatacacgcgcaatcgccgtgccgtacgtcgccgggtcagcgactccgcggtcgcgggtgccatccggtgccggtgtgtgttccaccgggcgccctcctccttcaggaactgggcgcgctcgtcgggcgtcaggctgcgccagagcctcgcggtgtgcgggcgcagactgtcgagggcgggacgccagtcgccgtgggtgcgcacggcccggctgatgtgtcggtagacggcccgccgcagctccgccaaggaggatcccaggtcctcgggtgcgggcatcgtgcccgccggagtgagcgcgtgcggctgcggcagcagaccgctgcgcgagacggcgtgcaccgtgcgcccgggccggtccagcgtgagcgccagatcgacggcggtgagcccggtgccgacgagcagcacgtcggcaccgtccgcgcgcgggccgtccagggcgcccggggcccagggagccgcgacgaacctcgccgaggcgcgcagcgcgggcggtgcccagtcgcccggcgagcccgcgggcccggtggccaggacggcgctgtcggccgtgacgcggcccccgtcggcgaggtgaagctccacccggccgtcgggggcgtcggtacagctctccgcccgcaccctcagccgccgcacgcccaccaccccctgcgcacggacgatcgcctgaccgagcgtgtcggccagataggcgccgaaccggtagcgcgtggcgaagtcggcgccggtgacggtcggttcgccgtgccggcacagccagcgggtgaagtgcccggggtcgtcgggatagcaactcatgccgcccgcgggcacgttgagccgatgccgcgggtcggacgtggcgtaggcggtaccgcggccggcctcgggcgccgggtcgacgagcacgaggtcgaggggcgtacggcggcgcgtcgccgtctcgcacagctggatcgcggtcagtgtgccggccgcacccgctccgacaatggcgacggtgtgccgtgtgcgggctggaatcacgtgtacctccggcggtgatcggctgcggagccgttgaacggaacgtctgcttcgcttttccgaactattccgaccgggttgctggggatgtcgtacccggccggggatctcaccggaaactcagggcaccggtcggctgtttcatactctgttcacaatcggcggggccccgacaaccgtggttcaagacgtctcccggagtgtcttcacaggaatctcatgtgagcgccctcggattcaaagattcaacccagggaggtggcgcacgatgcacgcgcacctggtggttgaacgaggaaaggcgtgccgtgggcgtcccgcacatatcgaacggatccgggcgacagtcctggtcgcgacgcggggccctggccgcactcgccgccgccctgccggccaccgtcctcaccggctgcggcggttttgcggacgcctctgaggacacgaagagcacgggcggaggcacggcagggaacacggccggcacggccgacgcgaagaccaccgaggcgaaggcgcccaccctcaccgtcaccccggccgacggcacgaagaaggcggacttcagcagccccgtcgaggtcaccgtgacccacggcaccctggcctccgtcaaggtcagcggcaacgacggcgccacgctcgccggccgctacaacgacgcccgtacgaagtggacgtccaccgggaacccgtactccggcaccacatacacggtcacggccaaggcgaagggagccgacgccgagaccgtgaccttctccaccaagtcccccggcgagaccttcgtgggctacttcacccccgaggcgaactcgacctccggcgtcggcatgcccgtatcggtcaacttcacccacgccgtcgcggaccgcgccgccgtcgagaaggcgatcacggtgaccgccgagccggcggtcgaggtggtcggccactggttcagcgacacccggctcgatttccggcccgagacgtactgggccgcgggcacgcggatcacgctcggtctgcggctcaaggacgtcgagggcgcggacggcgtctacggcacccagtccaaggacgtcaccttccacatcggccgcgagcagatcagcacggtcgacctcgccaccaggacgatgacggtgcggcgggacggctcgacgtacgcgacctaccccgtcaccggcggcgacgccgaccacaccacctggtccgggatcatggtgatcagcgagcgtttcacggagacgcggatggagtcctccaccgtcgggctcggcgacgagtacgacatcaaggatgtgccgcacgcccagcggctgaccacctccggcacgttcatccacggcaactactgggccgggtcctccgtcttcggtcacaccaacgcgagccacggctgtatcgggctccaggacaccaagggcgcgaacgacagctccgtggcgggctacgcgttctacaagagctcgatgctcggcgacgtggtcgtggtgaagaactcgggcgaggacacggtcgatccgtccaacggcctcaacggctggaacctgtcgtgggaccagtggcgggcgggaagcgccctttcccgttgagccatcagcgacggccactgggtacggacctcaccccgttctcaaagtggatcaccgggggcggcgggcagaacaccgcgcagctgagcaccagttgtgagcggtgggtggcgcagagtttcgccacccacggcgcggactgctgggtgtacgcgatccaggccccccgcgggatcgacgtgaacgccaccgcgcggcagaacggcatcgagtcgacgtacctgtggaacaaggagatcgacttccccggcggcatccagggcaggttctccagggagcgtgtcgttaccactgggtcggcgcccacccgcagacgaacgccagcatctaccagaacctcggctgccggacgaacagcaactgacgaacagcaacttccgccccgcccccggcgcacaggcggacctggccggttcgacgcgctgagttcccccgggaggagacgccggggcacgccgtcctcggacccggcggccccaggcggcccagcggcggcccaggcggcccggcatgagggggcgccgcccggggggggcgggcgggacttcccgccttcaccgtgtgaacttccttgcggcacagggagtttctcggttttacctcttgacggtcccagtggcggagagcacattggccgcgcgtcttgagagcgctctcaaggacacatcgcgcaccccactccgtaccgaagaggcacccacatgagtgaaacttccggcatatccgcgagacggcggtcactgcggcgcgcgctcgtcgccgtgctcggcaccctgagcctggcggcggccgccgccacagccgcgaccctccccgcgaacgcctccgcccccacgcccccggcaggctggacccaggtcttcctcgacgacttcaacggcgcggccggttccggcgtcagcaccgccaactggcagtacgacaccggcaccagctacccgggcggcgccgccaactggggcacgggcgaggtcgagacgatgacctccagcagcaacaacgtgtcgctcgacggcaacggaaacctccggatcaccccgctgcgcgactccgcgggcaactggacctcgggccgcatcgagaccaaccgcaccgacttccagccaccggccggcggcacactgcgggtcgagtcacgcatccagctgcccaacgtgaccggcgccgccgccaagggctactggcccgccttctggatgctgggcgcgccctaccggggcaactaccagaactggccgagcgtcggcgagctggacatcatggagaacgtccagggcctcaacaccgactgggccaccgtgcactgcggcaccaacccgggcggcccgtgcaacgagaccagcggcatcggcggcaacaccccgtgcgccggaaccacgtgtcaggccagcttccacacgtacgccatggagtgggacaggtcgacgagcaccgaggagatccgcttctacctggacggcgtcaacttccatacggtgaaggccagtcaggtcgacgcgacgacgtgggcgaacgccaccggccacggcttcttcgtcatcctgaacgtcgcgatgggcggcggcttccccgccgcgttcggcggcggtccggacagcggcaccgaccccggccacccgatggtcgtcgactatgtgcaggtgctccagtcgagcggcgggagcggtaccacaccccctccgtccggcagccgtgacgcatacagcgccatccaggccgagtcctacgacagccagtccgggacgagcaccgagacgaccaccgacacgggcggcggccagaacatcggctcgctgggcaacggcgactgggcgctctacaagggggtcgacttcggctccaccgcggcgaagcagttctacgcgcgggtcgcgagcggcgcggcggccggcgtcagcgggctggtggaggtacgcctcgacagccgcaccggctcaccggtcggcagcttctcggtggccggcaccggtggctggcagagctggagaacggtcccggcgaacatcagctcggtcaccgggacccacgacgtctatctgaccttcaccagcggccagtcggccgacttcgtgaacgtcaactggttcgacttcggtcactgaccggttcctgggggctccacgcgcacgcgtggagcccccattcgcgtccgggcgacctcgctccgccacgcgtccgggcggcccggctccgctcagcgcagctccgcccggaacgccgccggagtggtgtccgtgtgctggtggaagaacttggagaagttggccgagtcggggaaacccaccgcggctccgacccggccgatcggcaggtccgtgtgcgcgagcaggcgcttggcctccagggtcacccgcttgtcgatgaaccccttgggggtctggccggtggcggcgcggaccgcgcggaccagggtgcggcgggagtagccgagggtgtcggcgtacgcgctgacgctgtggttggtcgcgaagcccttctccaccgcgtccctgaagcgggtgaaggtggtgtccgtctgctcgcggccggcctgcgccgagctgaccgcgagatgggccaggcggaacaggaacgcggtgagcgtgtgccgcagcaccgaggtgtgcaggctcagcggcagcgtcgtcgtgtcgacgtactcgcgctccagttgggcgagggagtgttcgagagcggcgagccggtccgggtcggggtgcagcagcggcggcaggtcgtagcggtagaggccggtcgcctcgaccgtggcccggggcaggaaaccgggctgcatggtcaggacggtcccgcggtactcgtcggtccgggagaagcggtgcacctgtccggggcggatccacagcacgtcaccggcggaggcctcgtactcggcgaagtcgatcatgtgccggaccgggccgtcgtggaacaccatcacgacgtggaagtcgatccggtgcacgcggtccaggggggcgtccgcatgccagatccggtcggcgcccatcgggccgacctgcatgccgacgccgaagacgctcaggtcgacggggaaggggaaggttctgatcccgtcaccttcatgggcggctcgggtggttctgtctgccatgtccctctcgcggcggctcggccctgctgtcggtgtcccactttcaccgaaggctgacacaggggcaccttccccggcaaaagtcagacttttaggtttgaaggcgttccaccagtgactccccgtttcgtgaggacttcttgaagatgagcacgcacacccacgacagcttcgagtggaccgacctcgaccggcgtgccgtcgacacggcccgcctgctggccgccgatgccgtgcagaaggtgggcaacggccaccccggcaccgcgatgagcctggcaccggccgcgtacacgatctttcaaaaggtgatgcgacacgaccccgccgatcccgagtggaccggccgtgaccgtttcgtcctctcccccggccacacctcactgactctctacacccagctcttcctcgccggatacgagctggagctcgacgacctgaaggcgttccgtacgcacggctcgaagacacccggccaccccgagtacgggcacacggccggcgtcgagaccaccacgggcccgctgggccagggcgccgccaacgcggtgggcatggcgatggccgcccgctacgagcgcggtctgttcgacccccacgcgcccgagggcgagtcccccttcgaccacaccatctgggcgatcgtctcggacggcgacctggaggagggcatctccgccgaggcgtcctccctcgccggtcaccagaagctgggcaacctggtcttcctctacgacgacaaccacatctccatcgagggcgacaccgccaccgccttctccgaggacgtaccgaagcggtacgaggcgtacggctggcacgtccagcgcatcgagccctccgccgacggcgacatcgacgtccacgcgctgcacgcggcgctcaaggcggcgcaggccgagaccgagcgcccctcgttcatcgcgatgcgcacgatcatcgcctggcccgccccgaacgcgcagaacaccgaggcctcgcacggctcggcgctcggcgccgaggagatcgcggccaccaagcgcgtcctcggctccgaccccgagcagaccttcgaggtcgcggacgaggtgctcgcccacgcccgccgcgccctggaccgcggcgccgaggagcacgccgcctgggacaagcggatcgccgagtggcgcaccgcccagcccgagcgcgcgaagctcttcgaccggatcgtcgccggtcagctccccgagggctgggagcagtccctccccgtcttcgaagcgggcacgtccgtcgcgacgcgtgccgcgtccggcaaggtcctccaggcactcggcgcggtcatccccgagctgtggggcggctccgccgacctcgcgggctcgaacaacaccacgatcgacaagaccagctcgttcctgccgaagggcaacccgctgcccgaggccgacccgtacggccgcaccgtccacttcggcatccgcgagcactccatggccgcggagatgaacggcatcgcgctgcacggcaacacccgtatctacggcggcaccttcctggtgttctccgactacatgcgcaacgccgtccgcctctccgcgctgatgcagctgccggtgacgtacgtgtggacccacgactccatcggcctcggcgaggacggccccacccaccagcccgtcgagcacctcgcctcgctgcgcgccatccccggcctgaacatcgtccgcccggccgacgccaacgagacggcgatcgcctggcgcgagatcctcgagcggcacgccacccacccggccccgcacggccttgcgctgacccgccagggcgtaccgacgtacgaggccaacgaggacgcggcgaagggcggttacgtcctccaggaggcgtccaccggaaccccggacgtggtcctcatcgccaccggctccgaggtgcagctcgccgtcgcggcgcgcgagcggctggaggccgagggcgtcggcacacgcgtggtctcgatgccgtccgtggagtggttcgaggagcagtcgccggagtaccgcgcgagcgtccttccgccgtccgtgaaggcccgcgtcgcggtcgaggccggtatcggtctgacctggcaccggtacgtcggagacgccggacgcatcgtttcgctggagcacttcggcgcctccgccgacgccgagaccctgttcgccgagttcggcttcaccgccgagaacgtcgccgccgcggcccgggaatccatcaccgccgcgcgtggttgagcagaccgcaagaaagaagatgatcactgtgagcaacaccgtcgaaaacctcgagcgcctctccgacgaaggcgtctccatctggctggacgatctgtcgcgcaagcggatcacgtccggcaacctcgccgaactcatcgcgcacaagcacgtggtgggcgtcaccaccaacccgtccatcttccaggccgccatcggctccggagagggatacgaggagcagctggccgatctggccgtgcgtggcgtcacggtcgacgaggccgtgcgcatgatgacgaccgccgacgtgcgcgccgccgccgacatcctgcggcccgtgtacgacgcgaccggcggccgtgacggccgggtctccatcgaggtcgacccgcgcctcgcccacgacaccgaggcgacgatcgccgaagccaagcagctcgcctggctggtggaccgccccaacgtgatgatcaagattccggcgaccaaggccggtctccccgcgatcaccgaggtcatcggcctcggcatcagcgtcaacgtcacgctgatcttctcgctcgagcgctaccgcgaggtgatggacgcctacctcgccggtctggagcgggcgcaggccgcgggcatcgacctggccggcatccactccgtcgcctccttcttcgtctcccgcgtcgacagcgagatcgacaagcgcctggcgaaggccggcacggacgacgcgcaggccctcaagggcaaggcggcgctcgccaacgcccggctcgcgtacgaggcgtacgaagaggtcttcgccggggagcgctggaccgcgctcgccccggccggcgcgcacaagcagcgtccgctgtgggcctcgacgggcgtgaaggacccggcgtacaaggacaccctgtacgtcgacgagctggtcgctcccggcacggtcaacaccatgccggaggggaccttgaacgccaccgccgaccacggcgacatccacggcgacacggtgaccggcggctatgcccaggcccgcgccgacctggccgccgtggagcggctggggatctcgtacgacgaggtcgtgaagcagctggaggacgaggccgtcgccaagttcgaggtggcgtggggcgacctgctggaggccgtcgcgacctcgctgcgcggcaagggagctgacggcgaatgagcaagactccttcgaccgggacgccgggcaccgagaagcctgtcaccgggacgccggccaccgagacgcctgtcacggaggctccggtcaccgaggctccggtcaccgaggcgtcggccgtcgactgggccaaccccctgcgcgacccccgggaccgccgtctcccccgtatcgcgggcccctcgggcctcgtcatcttcggggtcaccggcgacctgtcccgcaagaagctgatgccggccatctacgacctggccaaccgcggtctgctcccgccgggcttctcgctcctcgggttcgcccgccgggactgggaggaccaggacttcgcgcaggtggtgcacgactcggtgcgcgagcacgcccgcacggagttccgcgaggaggtctggcagcagctcgccgagggcatgcggttcatcccgggcgacttcgacgacgacatggcgttcaagcaactgcgcgcgtccgtcgacgagctggacgcctcccgcggcaccagcggcaactacgccttctatctctcggtaccgccgaagttcttcccgaaggtcgtccagcagctcaagaagcacgggctcgcggacgcgccggagggctcctggcggcgtgcggtcatcgagaagccgttcggccacgacctggccagcgcgcgtgagctgaacgcgatcgtgcacgaggtgttcgacccggaccaggtgttccgcatcgaccactacctgggtaaggagaccgtccagaacatcctggcgctccgcttcgccaaccagatgtacgagccggtctggaaccggtcgtacgtcgaccacgtacagatcaccatggccgaggacatcggcatcggcggccgtgcggggtactacgacggcatcggttcggcccgtgacgtcatccagaaccacctcctccagctgatggcgctgaccgccatggaggagccggccgccttcgacgccgagtcgctgctcgccgagaagctgaaggtcctcaagtccgtgaagctgccggggaacctgggcgagcacaccgtgcgcggtcagtacacggcgagctggcagggcggcgagcgggtgcgcggctacctccaggaggacggcatcgaccccaggtcgacgacggacacctacgcggccgtgaagctggaggtcgacaaccgccgctgggcgggcgtccccttctatctgcgcaccggcaagcgtctgggccgccgggtgaccgagatcgcggtggtcttccagcgcgcgccccactcccccttcgactcgaccgccaccgaggagttgggcgccaacgcgatcgtcgtccgtgtccagcccgacgagggcatgaccgtgcgcttcggttcgaaggtgccgggtacgtcgatggagatccgggacgtctcgatggacttcgcgtacggcgagtcgttcaccgagtccagcccggaggcgtacgaacggctgatcctggatgtcctgctcggcgacgccaatctcttcccccgccatcaggaggtggaagagtcctggaagatcctcgacccgatcgaggggtactgggacacgcacggcaagcccgcgcagtacccctcgggatcctggggtcccgaggaagccgacgagatgctcgcacgagacggacggagctggcgcaggccatgaagatcgacctgaccgacaccacggcaagcaagatcaacaaggcgctcgtgcagggacgccatgccatcggcactcccgccgtgggcatggtcctgacgatggtcatcgtgaccgacgaggagaacgcctacgacgcgctcaaggcggccgaggaggcctcgcgcgagcacccgtcgcgcaccctggtcgtcatcaagcgcgtcgcccgcaccccgcgcgaccgcacgcagtcccgcctggacgcggaggtgcgggtcggctcggacgcgggtaccggggagacggtgatcctgcggacgtacggcgaggtctccgaccacgccgactcggtggtcctgccgctgctgctgccggacgccccggtcgtcgtctggtggccggtggacgcgcccgacatcccgtcgaaggacccgctgggcgccctcgcgcagcgccggatcaccgacatgtacgcggtggaggcaccgctcgccgcgttggaggcccgggtctcctcgtacgcgccgggcgacaccgacctggcctggacccggctcaccccgtggcgttcgatgctggccgcggccctcgaccaggcccgtacgccggtgatctcggccgccgtcgagagcgaggcggagaacccgagcgccgaactgctggcccgctggctgggcgcccgtctgcatgtgccggtggagcgggtcgtcaccgcgggccccgtggtgacggccgtacggctcggcaccgagaagggcgagatcctcatcgaccgccccgagggcccgctggccacgctgtccctgccgggccagcccgcgcgcaccctcgcgctgaaggtccgcagcacctccgaactgatcgccgaggagctgcgacgcctcgacgcggacgagatgtacgccatcgccctgcgcggcgaggcggccgaggagaacaccagtcatgtctgacagccccaggctcacccgtcgccccgagtggacggaactggaggaccatcgcgcgggtccgctgctccacccggcgctgcgtgagctgttcgcggcggaccccgagcgggccgagcgctatgtcgtgcgggccggcgatctgcgcctcgactactccaagcacctcatcacggacgagaccctcgccctgctccaggaactcgccaccgccaccgacgtgttcgggctgcgggacgccatgttccggggcgagaagatcaacgtcaccgagaaccgcgccgtcctgcacaccgcgctgcgcgccccgcgcgacgccgtgatcgaggtcgacggcgagaacgtcgtcccggccgtgcacgccgtgctcgacaggatggccgacttcgccgaccgggtccgctcgggcgagtggaccgggcacaccggcagccgcatccgcacggtcgtcaacatcggtatcggcggctcggacctgggccccgcgatggcgtacgaggcgctgcgggccttcaccgaccgctcgctgaccgtgcggttcgtgtcgaacgtggacggcgccgatctgcacgaagccgtacgggacctggacccggcggaaaccctgttcgtcatcgcgtccaagaccttcacgaccatcgagacgatcacgaacgccacctcggcgcggtcctggctcctcgccgggctcgacggggacgagaaggcggtcgccaagcacttcgtggcgctgtcgacgaacgccgggaaggtgtcggacttcggcatcgacacggcgaacatgttcgagttctgggactgggtcggcggccgctactcgttcgactccgcgatcggtctgtcgctgatgatcgcgatcgggccggagcggttccgcgagctgctcgacgggttcaggatcgtcgacgaacacttccgcaccgcgcccgcggaggccaacgcgcctttgctgctcggcctgctgggtgtctggtacggctcgttcttcggtgcccagtcgcacgccgtgctgccgtactcgcactatctgtccaagttcaccgcctacttgcagcagctggacatggagtccaacggcaagtccgtggaccgggacggccatcccgtggagtggcagaccggcccggtggtgtggggtacgcccggcaccaacggacagcacgcgtactaccagttgctccaccagggcaccaaggtcatcccggccgacctgatcgggttcatcaacccggtcgacgggctgagcgacgaactggcggcccagcacgacctgttgatggccaacctcttcgcccagggccaggccctcgccttcggcaagaccggcgacgaggtacgcgccgagggagtgccggaggagcaggtgccgcaccgcaccttccgcggcaaccaccccaccaccacgatcctggccgccgagctgaccccgtcggtcctcggccagctcatcgccctctacgagcacaaggtgttcgtccagggcgcgatctggaacatcgactccttcgaccagtggggcgtcgaactcggcaaggtcctcgccaaacgcgtcgagcccgccctcaccgaaggcgcggacgtacccggcctcgacccctccaccgccgccctcgtggccgcgtaccgcactcaccggaagaagtgaaagggcatgacagcgatgcagctcggactgatcggtctcggcaaaatgggcggcaacatgcgcgagcggatccgccgcgcgggccacacggtcgtcggctacgaccgcaaccccgaggtctcggacgtcagtagcctcaccgaactcgtgagcgccctcgaaggcccgcgcgtggtctgggtgatggtccccgcgggcgccccgacccagtccgtcgtcgacgagctcggcgacctgctctcccccggcgacaccgtcgtcgacggcggcaactcccgctggacggacgacgagaagcacgccgaggagctggccgccaagggcatcggcttcgtcgacgcgggcgtctcgggtggtgtgtggggtctccagaacggctatgcgctgatggtgggcggcgacgcggagcacatcgctcgcgtccagccgatcttcgacgcgctcaagccggagggcgacttcgggttcgtccacgcgggcaaggtcggcgcgggccacttctcgaagatggtccacaacggcatcgagtacgccatgatgcaggcgtacgccgagggctgggagctcctcgagaaggtcgactccgtgaccgatgtgcgcgcggtcttccgctcctggcaggagggcaccgtcatccgctcctggctgctcgacctcgcggtcaacgccctggacgaggacgagcacctggagaagctgcgcggctacgccgaggactccggcgagggccggtggaccgtcgaggcggccatccacaacgccgtgccgctgcccgcgatcaccgcctccctcttcgcgcggttcgcctcccgccaggacgactcgccgcagatgaagatggtcgcggcgctgcgcaaccagttcggcggccacgccgtcgagtcagcggagtagggctccatgggcgacctcatactggtccgccacggcgagaccgagtggagcctgtcgggccggcacaccagccggaccgacctgcccctcacccaccacggtgaggagcaggccaagtccctggcgcccttcttcgccgggcgctcgttcgcccgcgtcctcaccagccccctcgaccgcgcggtgcgcacggcggagctggccgggctgaccggggccgtgaccgaccccgacctgcacgagtgggactacggcgggtacgagggcatcacgaccgtcgagatccaccgcacccggcccgactgggacctgtggaccgacggcgtgccgtcggcctcggacgggtcccgcggtgagtcgccgcaggaggtgggagagcgcgccgaccgtgtgctgtcccgggtggacgcggcgctccggggtgacggagaagacgtggtcctggtggcccacgcccacttcctgcgggtcgtgaccgcgcgccgcctgggcctgcctcccgagcaagggcggctcttccggctcgccaccggcacggtcagccggctgtccaccgaacacggacgtccggtgatcgcgacgtggaacgagtcgggaacttcccacgggcaccactagtttctacgttgctgtagagaaaaggttacggcccgcccactggggcgggccggcccgcgacaacgaacgtatggagtcctcatggccctgtgggaccgcatcaaagagtccgcgtcgacgatgcagacccagctcgaggcgaagaagaacgacctgaagagcggcgccttccgcgatgcgagcatggcgatgtgcgcactcgtggcggcggcggacgggtcggtggacccgtccgagcggcagcgtgtggcccagctgatcgccaccaacgaggtgttgcagaacttcgacgccgacgacctgcggcgccgcttcgacgcgaacctggacaagctgaccgccgacttcgccttcggcaaggtcagcgtgctccaggagatcgccaaggccaagaagaagcccgccgaggcgcgtgccgtcatccagatcggcatcgtcatcggcggcgccgacggcgacttcgacaagaccgagcaggccgtcgtacgggaggcgtgcttcgccctcgacctgccgccgcacgagttcgacctgtagcggccgcccagctccacccccggccccggtcacgcacgtcttcgcactcgctccgcacccctggtgcgggcgggcccgtcggcgtggtggccggggccgcggtcgtcgaaggggagcgccggtcgtcgaaggtgagcgccgcgtccaccggtccgcgcggcctcggcaggggaacccgcgggcgaacggcgcgtacccgagacgacacccgaccgccacactgacgtggacaaaacaccgcttcccggccaagtgttcgtagagggcgacgagaggcgcgcatggcgggaaagccccgccgtgggcactccggggcgccggcagcgtgccggcccctgtcccgtacgcatccgtgcgaaggaagcgaccgatgaccgagaccgggcggcacgaacagcagtacgagcggtatgagggtggcagtcccgaggcggagcgccaggtgttcgagcggctggcccgggagatcatggaagtccaggtcaaaaaccagcgggcccagggcggcgggatctcgcgcaccttccacgccaaggcgccgctggccgtggagaacgcgcgactgcgcttccacgacgacctgcccgaggccctgcgggtcggcttcgcccagccgggcgccgactatccggcgaccgtgcgcctgtccaacgcgagcggcgtccagcagggtgacggatcgcccgacctgcgcggtgcggccgtccgcgtacgggtgtcggaggacgagagccacgatctgctggcgaccagccatccggtttcgcacgcccgcgacgcccgggagttcgtggccttcgccaaggcgatggcgggtgcccgcagccccctccagaaggccttcgggctgttcgtgaaactcccgctggccgtgggcctcggcaccgcgaaccggatgcggcgcaatgtgcaggcggcggcccggcacaccgtcgactccctcgcgagcgagacgtactggagccgcggggcgatcctgtggggcgaggcgggtccggtgcgctatctgctgcgtccggccccgggcagcccgccgccgctcccctgcgacccgaacgacccggacttcctgcaccgcgagctggcgcagcggctggccaggacggacatcgcgttcgacctgtgcgtgcaaaggttcgtcgatgaacgccgcaccccggtcgaggacgcctcggtggagtggcaggaggcgatcgcgcccgcacagccgatcgcccggctcaccattccggggcaggacctcgacgacgcgaaggcgcgcaccgtcgcccgccggatcgaggacctcgccttcaacccctggcacacgacggacgacttccgtccgctcggcaacatcaaccgggcccgcaaggccgcgtacggggcgagcagcgcgcaccggctcgggctgcggttcagcaccgcggagccgtggcagaaccggctgctcacgccacccgcgggtgcggccttcggcctgctgaaccgagtgctgccctggcaccggctgccgttgcggctgagcctgctgaacctggtgttcctgcggaaggcgctgcgccgcttcaacctgatcgacaccgagccccgcgaggctcccccgaaggcccagccggtaccggagccgattccggagcggctgcgcaccgagcggtcctacgacggctcgtacgacgatctgtccgagccggggatgggcgccgtgggcgccgccttcggccgcaacgtcacgccggactaccggcccgacctcttcgacaccccgaacccggtgacggtcagccgccggctcctgtaccgcgagagcttccagcccgcgacctcgctcaacatcctcgcggccgcgtggatccagttccaggtgcacgactgggtcaaccaccgccgccaccggcccgggggacgcacggtcgaggtgccgctcccgcccggcagcggcgactggcacaacacgccgggcgggccgcccgagaacgtgatgcggttcgcggagaacgagggcctcgaactgcccggcgaccggccgccgatcctcttcggcaacgtcgcctcgcactggtgggacggctccgaggtgtacggcgaggacgagcagaccgctcgtttcctgcgcgaaccggacggcggtgccagactccgcctggaggacggccacttgccgggcggcacgaacgggatcccgctcaccggcttcagcgagagctggtggatgggtctcagcgcgatgcacacgctcttcgcgcgcgagcacaacgcggtctgtgacgcgctgcgcgccgagtacccgtcgatgagcgaggagcggatctaccggacggcacggctggtggtctcggcgctcatcgcgaagatccacacggtggagtggaccccggcgatcctcgccaccgaggcgatcgacatcgggctccacaccaactggcagggcccgccgcggaactggctcaacaagctgggtctgtggctgttcgaggcgcactcgctgaccggcatccccgggacccggccggaccaccacggggtgccgtactcactgaccgaggacttcgtcaccgtctaccgcatgcacccgctgatcccggacgactacgagctgcgcgagcaccacttcgggcagcgcctggagacggtcgggttcctggacatccagggcggcgcggccgaggcgaagatccgcaagacgggcctggcgaacacgctgtactcgttcggcatcgcccatcccggcgcgatcaccctgcacaacttcccgcgttcgctccagcagttcgagcgggacggcgagatcatcgatctgtcggtggtggatctcgtccgcacccggcggcgcggcgtcccgcggtacaacgacttccgggcgggcctgcacaagaagcgcatccgttccttcgaggagctgacgcggaacgccgagacgctggcgcggctcaaggaggtctaccgctcggtcgacgaggtcgacaccatggtcggcctgctcgcggagaacccgccggccggcttcggcttcagcgacaccgcgttccgcatcttcatcctgatggccacgcgccggctccagagcgaccgcttcctgacggtcgactaccggcccgaggtctacaccccgctcggcatcgactgggtcgagaagggcggcatgaactccgtgatcctgcggcactgcccggaactggcgtcgctcatgccgcgccgggcgagcgcgttcgcgccttggcggacggtgcagccggcggccaacggcggcccccctgacaacggcggccccggtgacaacggctgactccggcgctaggagcgcaccaatggcacgccgcgctccggggaccagggatttcggccgaccgggcggcagttgacagcttcggtgcggcacgccagagtcccgcgagatggagatcaacgacctgacgcctgccgagcgacgtgtgtgggaggcctttccgcggggcgcgtccgtggacttccgcacacctgacgcggacaccgaggccgctgagtggggaccggagcggaccgtgcgagcgagcgtcctgcgggcactgctgctcacggcaccgcaggaggagggcgagacggccgcgctcaaggtcgcgggtgcccggatcaccggcgtactgagtctgatgtacgcgacgatcggccatgtcgtccggctgagccactgccggttcgaggaggcgcccaagctgcacggcgcccagcttcgtcagctcaatctgcggcagtcggtgctgcccggcctggcctcggggaacgtacggatcgacggcatcctgcggttgacggactgccgtgtccacgggccggtgcggctcgatggcgcgcagatatcccgcgcgctcttcctcgacggtgcgcggctctccgcccaggacgacgcgcagcccgtgctccagctcaaccaggccgccatcggcgacgacctgtgggcgccgaagctccgggttcggggtgaggtgcggatgaacggcatccatgtggccgggtcggtcaacctggaggacgccgatctgagcgcgcacgcgggcaccgccctcagcgccgagaccctcagcgtgggaaccgatgtgcgggcgcgctgcctgcgcgcggacggccggctcgagctgcgcggcgcccggatccccggccggctcgatctgctgcacgctcgtctctcgaaccccggcggcacggcgctgcgggcgagcagctgcgccatcagggaactctggctgcgcgacggcgaccggatcgagggcgtcctcaatctgcgccgtgcgcagatcgacctgctgaccctggccccggagatgctgcccgacgaggtgtttctgagcggtctcacctacaccatgctcaccccgaacgagcccgccgagcgccgtctgccgatgctcgaccgggacggcggcggctatctcccctccggatacgagcagttgagcgccgcgtaccgcagaatcggcgacgacaacgcggcccgcctcgtccaactcgccaagcagcggcgccatcgcgccaccctggcctggtacgcgcggatctggggccacgtccaggacgccaccgtcggctacggcttccgtccgctgcgtgccgccggctggctgctgtccctgctggccgtgggctcgatcgcgtacggcgtgcatccgccccacccgctcaaggcctccgaggcgccgcccttcaacgccgtcttctacaccctcgacctgctcctgccggtcatcgacttcggtcaggagcgggccttctcccccaccgactggtaccagggcctgtcctacgtcctcatcatcaccggctggatcctggcgacgacgatcgtcaccggtgtgacgcgcacggtcagccgtcagtagtacggctcaccggaccggccgccccgcgtgctgggcggccagccgcaccggtgcgttctgggctccgtaaccgcggtggccggcgtcacgctggacgagttcgaagaagacgcggccgaccgtctccgtgtagcagtgccggaacgcgccgcccgcgtcacggtcgtagaggatgccgagttcgcggtacgtctccagctcgccgtccgcgaactcgtaccgggcggccaggtcgtcgtagtagttcgccggaatccgcagcagccggccgcccgccgcgcgaaagcggcgggccgtggcgaccacgtcctcggtggcgaacgcgatgtgctgggcccgggcgccgtcgtcggtcggtgcgggtccgacgctcagcgcgatccgcacactgccgtcggcgttggtgacggcacggctgcggtgcagaccgtaggggtcggcgacgtcgacgctgtcctgcgcgttcagaccgagcacgctgcggtggaacagggccgcctcgtcgaactggtgccagggctgggtgagggcgagatggtcgacccgggtgacgccgtgcgcgggggcacggcccggcgcgtccgcgtccacttccaggtccgcgaagtcgcctcgccagtcggggagttcggggcgggcggcgcagaagaagagttcggtgccgtcgggcgcggcgaccgcctccaggggcgcgtcctccagggcgcggcggcgcggcagcaccggggcgagcagggcctcggcgcggcgggccgcggcggccgggtccggtgactccaggccgacggcggcgagcgaggtgccggcgcggcgggcggcggggcccgtgttgaccaggacgcgcgccgcaccctgctgccagaggtccaccggcttggagcggtgccgggcggtgcgaccgaaaccgagcgcgctcaggagcgcggagaccggctcgacgtcgggtgtgacgagttcggcgaaggcgatcccggtgggcaccacgggcgcggggggtgtggcgagtccggtcgcctcctggagggcgagcagcgagcgctgggcgtccacggcggtgggtccggcctcggcctgccggaagacgtcgttgaagacctcgagggacagcggtccccggtatccggcgcgcatcacatgtccgaggaacccggcgatgtcgaagccgccctggccggggaaacagcggtagtgacggctccactggaggacgtccatcgccatctgcggggcgtcggccagttgcaggaagaagatcttctcgccggggatgtcctcgatgcccttggggtccgagccgcgggcgaggatgtggaagctgtcgaggcaggtcccgagcgcggggtggccggcggcctcgacgatgcgccaggcgtggtcgtacgtacgcacatggcgcccccacgccagcgcctcgtaggcgaccctgatcccgaagtccgcggccagttcggccagtcggcgcagctgccgggcggcgagcgcgtcgtcgtcctcggcgagcggggagacgctggagcagacgaggacggtgtccgcgcccaggcgtcgcatcagctcgaacttgtggcgcgcgcggcgcagattgcggctgaactcgtccgccggtacggcctcgatgtcgcgcatcggctggtagaggtcgatgctcagaccgaggtcggcgcagcgggcccggatctcctcggggctgagcgggctggcgagcaggtcgttctcgaagatctcgacgccgtcgaagccggcccgggccgcggccgtgagcttctcggtgagggacccgctgagcgagacggtggcgatggacgtacgcacggggtgtctcccttctgtccgggcttcagtgccggacggccgcggtgccggccagttcggcgatgtcggcgagcatgcgcatgctgtcgggttcccgcccggtgaagagccggaacgcgtccaccgcctggaagacggccatgccgccgccgtcgagcgtggcgcagccgagcgcgcgggcggtgcgcagcagttcggtctccagggggcggtagaccacctcggcgacccacagaccggggtgcagcagctcggccgggagcgggattccggggtgggcggccataccggtgggggtggcgtgcacgatgccgtcggcgtccgtcagcagcttgggcagcgtgtccgggctcgccgcggcggcgcggccgtcgccgaagtgccggttcagtgccacggcgagggcggcggcccgctccggcagcgcgtcgacgacggtgacgtgcccggcgccgagtgtcagcagggcgtgcgccacggccgcgcccgcgccgcccgcgcccagctgtacgacccgttcgagccgggcgtcgggcagtccgcgcgcgaaggaggcggcgaacccggtgacgtccgtgttgtgaccgacggcgcggccgtcctcgaagacgacggtgttgaccgcgccgagcgcctcggcctgcggggcgagcgtgtccaggtggctgatgacgagctgcttgcaggggtgcgtgatgttgagcccgtcgaaaccgaggtcccgggccgcgcgtaccaggccgcccacggcttcgggtccgaccccgagcctgtcgatgtcgatcagccggtagtgatagcgcagtccctgccggccggcctcgcgttcgtgcagggcggggctgagcgaggggccgatgccggaaccgatcaggccgacgagatacgagtcctgggtcacggcggtcctcctgggctgccgccggacgggtcgcccggacagctgactaatgtacgaactagtacgttagtcatatcaggatgtcacgccgccgtgaagacatcgaccggaccgacccgcgccgaggccctgcttctacaatctcggcaccggcatctccgtccgaaggaacccgatgaccagcgtcgacgaaccggcaccaccgaacggccgcatccgcgacgccgcccgcaccagggccgagatcctcgacgtggcgacgcaggagttcgcgcgggccggatacgacggcgcccgggtcgacgagatcgccgcccgcacccgcaccacgaagcggatgatctactactacttcggcggcaaggagcagctcttcacggccgtcctggaacgggcctactccgtcatccgccaggccgagcaggaactcgacgtcgaacacctggacccggtcgcggccatccgcaagctcgccgaggtcaccttcgaccaccacgaagcgcaccccgacttcatccgcctggtcagcatcgagaacatccacggcgccgagcacatcgccgcgtccgaggagctcggccggatcggctcgcccgcgctggacgtgaccggccgcatcctggaagccggccgcagctcgggactgttcacggccgacgtcgacgccgtggacctgcacgcgctgatcagttccttctgcttcttccgggtctcgaaccgccataccttcggcgccctcttcggccgcgacctggtggcacccggccggcgcgagcactaccggaccatgctcggcgacctggtcatcgcctatctgacggcggaccgctccgcggactgagccccgcaccgcggcgccgcgcccggctccggaccaggaccgtgcgccggcccggaggcggagagccccttctgcgcgacctcttgacacccgggaaacgtgagcgcaccatccgtagccaaccgctactaactatccagtgggttaattagccgggcacgcacccggcgcggccgacccgtcaccccagggccccggcacctctcccctccgctcacccgctccgcccggagctcctcgaaggagtacgccgtgtccgtccccgccgccccgcacgacgcgccacccggccagccgaggaaggccgcgctcgccgcctggatcggcagcgccctggagtactacgacttcttcatctacggcagcgccgccgcgctgatcttcccgaaggtcttcttcgacgagtcggaccccgccgacgcgacgctgctctccctggccaccttcggtgtcgcctacgccgcccgcccggtcggcgcgctgttcctcggccacttcggcgaccacctgggccgtaagaagatcatggtcttcacgctgatcctgatgggcctgtcgacgttcctcatcggctgtctgcccacccgcgcccaggtcggcggcctggccccggtgctgctcgtgctctgccgtgtcctccagggcgtctccgccgccggcgagcaggccagcgccaactcgatgacgctggaacacgcgccaccgcaccgccgcggctacttcaccagcttcaccctgaacggcacccaggcgggacagcttctcgccaccctcgtcttcctccccgtcgccgcgctccccgaggaccaactgctctcctggggctggcgcgttccgttctggctgagcgtcgcggtggccgtcgccggctacgtcatccgccgcaccctccaggagactccggccttcgcccagcaggccgcggccgacggtgtcgcgaagctgccgctcgccgtgctgctgcgcgagcactgggccgatgtgctgcgtgtggtcgccgccgccctcatcgcctccgtgagcacgatcttcacggtgtgggcgctggcgtacgcgaccagcgactcggtcggcctgagccgctcgtccatgctgtgggtgggcgcgctcgccaacctggtcgccctcggcgcgatcccgctctgggccgtcctgtccgaccgcgtcggccgccgcccggtcttcctgatcggcgccgtcggcagcgcggtgctgatgttcctctacctgtgggccatctccaccggctcctaccctctggtcctgctgctcggcgtcctcaccttcggtgtcgtctacagcgccgccaacggcatctggccctccttctacggggagatgttctccacccgcgtccgcctctcgggcatggccatcggcacgcagatcggtttcgcggtcgccggcttcgccgtcaccttcgccgcgcagatcgccggtccggacggcgacgactggtcctcggtcgccctcttcgcctcggccctgtgcattccgccgatcgtcgcggcgctcaccgcccgcgagacgcacaaggtaccgacggaactgctcggcgagcgcccggcgcagggggccgcgaaccgcgagaccgtgacggcctgaccgacccgcccggtccgccgggcctgacgatccgttgggcccgccggtccactgggcccgcccggtccgcccgagtctccggcgtccgtcagacgtccggaggctcggacttcgcacggctgggacgcgtacgtccgcgcggcgaggaaccgcacggaaggcggcgcgatggcggctcaaccccgcggaatcccgtacgcccgctccacccgcaggcgcagcacgagccggcggtcgcggaccatcgcggcccggaagtcgtcccagtcggggtgctcgcccagcacgtcacggtagagccggatcagttcctcgacggtctcgtcgtgcgggtcccgcgcgaccggcgacagttcggccacgccctcgacgaccgtgtacgccctccggtcgggccccgtcacgtggtacgacgccctcgggtcccggcgcagattgcgggtcttggcgcggtcgtccgtgaccgacacccgcagcgtccgctcgtcggggtagtacgcgtgggcgacgttcgacaactggggccgtccgtcgcgcttgagggtgaccagcactccggcgagatggtcggagagcagcttcagcagtgcgtcctgcgtcgcgtcctgagtcatgtctgggtcaacccgccggtcccggcacgcattccgcgtagacactgtctacgagtctctggtagacagtgtctatgagcgatgaggggaccgggctgcgggctcggctgatcgaggcgggcgtcgacctggtggccaaggagggcgcgaacgcgctgtccctgcgggagatcgcccgtcgggcgggggtctcgcacggggccccgcgccgctacttccccacccacctggcgctgctctccgccatcgcgcggcgcggcttcgcggagctggcggagcgggcgacggcggcggtcggcgacggcggggcgagcccgcgcgcacaactggcgtccctgggacgggtctacctggacttcgcgctggacaaccggggcatgtacgagctgatgttccgtcacgacctgctggagagcaaccgtctggggctgcgcgacaccagcctgccgctcttcggtgtgctggtggacctggtcgcaagggcccgtcccggggcggacgcccgcgccgtcgccggctccctgtgggcgaacctgcacgggatcgcccagctgtggggctggggcagccttcaactcgccaccggcgcggtcgacttcgcacccctgctgggtacggccctggacgcgcacctcgggccggaggaccagtgagcgcgcaccggggtctcactctgacaagcagtgtcgtcggcgcggtgatcgtcgccctggacgggaccgtgctgaccgtcgcgcagcccacgctggggcgggatctgcacgcctcggtcgccgaggtgcagtggacgagcaccgggtatctcatcgcggtggcgagcctgttggtgttcgcgggccgcgtcggcgaccggtacgggcatcaacgcgtcttcgccgtgggcatgctgggtttcggcgcggcctcggccgggatcgggatggcggcgggcatcggctgggtgatcggactgcgcgtggttcagggggtgttcggcgcgctgctccagccggcgaccctcgggatgctgcgggccgcgtatccgcccgaccggctggggatgccgatcgcgctgcggacgagcgccatcggggtggcggccgccgccggtccgctggtgggcggggcgctggtcaccccgttcggctggcggtccgtcttcttcgtcaatgtcgtgcccgcgctggccatgggcggtctcgccctggccgtccgggggccggagcggacgcccccctccgggcggcggctcgacctgcccggcgcctgtctcctcgcggtggccctggcgtgcctcgtgcacaccctggtcgggattccggacggcggctggacgacggtgtccacgctcgggctgatcgcggcggccgtcgccggtaccgtcttcgtccaccacgaacggcgcacgccgagcccgctgctgccgcccgacgtgctcggttcggcggccgtcggtgcggcgctgggcatcctggtggccgcctcggcgtcgatgctcggcaccctgttcgtgagcagctacttccttcaggacgttctcggcctgactccgctggagaccgcccttcgggccctgccgggaccggtgatgatggtgctggcggcacccgcctccgccgtcctcatgcgccgctacggcccccgtcggacgaccgcctgcgcgatgacgctcctcgccctcggcgtcctcgtgctgtcccggctcggcgaagggtcgggggcgctgtcgatcggaaccggattcctgctgctcggcgcgggtttcggcacggtgatggtggccgccacggcggtcgtcgtacggcaggtggcggcgggcgcggccggcgtggcgggcggcctccagcagaccgcgatgaacgtggggccgacgctgggggtagcggcggcgaccacgctgatgacgtacacgcgcgtgggcctggctccgacgctgacggtgctggccgcgctggccgcggcgggcgcactgccggctctcgcgctgccgggccgctccggcagccggagcggagcccccgaggaatcactcacggcctcgtgagagagcatgacgtctgggaccgcggcccgggacggccgcgggagagaccggaggagaacatgggacacctgcggcaggaggccgagccgggcgaggtcgggctcgacccgaaggcgctggcccgcctcgaccagcacttcgcacacgaggtcgacgacggccggctgcccggctttctcgtgtccgtctcccggcacgggcgcgtcgcccacctcacgacgtacggccaccgggaccgcgcggccgaactcccggtggagaccgacacgttgtggcggatgtactcgatgacgaagccggtcacctcggtcgccgcgctgatcctcatggaggagggacggttcggactcgacacgcccgtcgccgagttcctcccgtcgttcgccgagccgcgggtgtacgtcgacggcgcgggacccgacatccgcacccgccccgccgggcagccgatcctgatccgccatctgctgacccacacggcgggcctgaccttcggcttctaccactgccatcccgtcgacgcccgctaccgggaggcgggcatcgagtcgtcggtgccaccgggcgcggacctggccgaggcgtgcgaggtgtacgcgggcctgccgctccagttcgagccggggacccggtggaactactccgtggccaccaatgtcctaggccggctcatcgaagtggtgtcgggccggcccctggacgacttcttcgccgaccgcgtcctgactcccctcggcatgacggacgccggcttctgcgtgacgccggagcaggcgtcccgtctcgccgagctgtacggcgagacggaggacggcggtatcgctccggtccccggcctgccgctgcacggccggccgcgcttcctctcgggcagcggcggcctggtggccacggcgtacgactaccaccggttcatggagttcctgcgccgtcgcggcgaactcgacggcgtccggctgctcgcccccaggaccgtcgccatgatgaccgccaaccagctccccggtggcgccgaccgccgtgcgttcggcaccacggtccaccaggagcccggcagcgccggtctcggcttcggcctcggcgtctccgtcgtcgtcgaccccggtgtgacccgctccccgtccgccctcggctcgtacggctggaacggggtggccaccaccacgttctgggtcgacccgcacaacgacatgacggtccagttcctcacccaggtacgcccgacgggctcgcaccgggtctacccggagctgaaacgcctcatccacgagtccctggcgggctgacagcgaggtcagggaccggacggcggcgagatctgctgcatgaggctcatcaggtccggggccacccattcctccgcgatcctgtcgccctcgatgcggtagagctcgatgctgcggaagccgaccggccggtgcgtcgcggccacgccctggaaggtgccctggtgggtgccgcggaagtggacgcgtaccgccaccttgtcgtggacgctgaacatgtcctcgacgtcgacctggaggtcagggaagccttcgagcatggcctgagcgcccagccgccagatctcccgcccgtgcagcgggtcgggtgtcccggggacgttggcgatgaagttctccgtcagcagctcgacgcacgcgtcgaggtcgccgctctgcagcctctgataagcggtgcgcagcaaggctgcgttcttctcggtggcggtggccatcaggtgtccttttctcggttctcagtgcaatggggggaattcaggtgagcgcgggccggcgcagggcgccgaccagcgcgcgcgggtcgtcggcgtggaagcggatggtccgtgcttcccctctgccgccgagcgggcgggtgaagaccagagggcgggtcagttccagggtcaccgtggtctgaccggccacgatcagatcgagcacccccttctcggacagcgtcacgagcctgccttgcgggtagcagcggtcgacccggaccgaggcgaccgcgtccgccgggacggcgaggtcgaagagggccccatagcggatccgcagggagccgtcggggcgcgccacgtgcggccgggtgacgcaggcggcgtgcaggcccagcatcatgaggaccccgtacacgtcgaggacgagcagcacccggtggacgacgggccacgggatcaggaccgccagcgcgaccgtctcgatcaccgagacgaagatcagtccgtacatcatcgccgtctgcggtccggtgtacccggcgacatggtccccggggcgaacaccgtgcttccggcgcgcggcccaccggccgagggaggcggcggcacgcagctcgtgcaccagtagccggcgtacccgtgcggggacgacggcacggacagcggcccgcagggcggccggtggctcgaggccctgggcgcgccggctcgcgtacagcgagcgcagcacccatgcctccagcatgagcaccgcgagcgccacggcctcggcggccgcagtcgcccacaccggcggccgtaccccggccgccaggcacaccgccaacgcgagctcccccggtatgacggcgccggccgcgatccgcgccgcccgcatcccgcgtacctccccggtcccgctcatccccggctcctgcgcatgaaagcctccatgaccctgcgtacgacttccgcctgcgcgggggcgtactccgcgagcagcgcctcctggaacccggccacgacctgtccctcggcggagatcgcggcgaacacctcgtcggggacggccgccaccagctcggctgccagcgccgggatccgcggatcgtccgtcggggcttcggcgagtgcgtcgaggcgttcgtagagcgcgagcagcgccgggtcggccgccaacggtccgagcgcggcgtacagttcctggccgccggagcccgcggcgtcgagcagcgtcaggtgctcgcggtccttcgcggcggcgggcgaggccgggtgcggcgtctttgcgaggagcgcggcgagcgcgggggacaggggttcggtgtcccgcggctcggcggccagcagcaccgcgagccgccgccggcgctccccgatctcggcctcctgccgggcgaggtcggcgtccagttcctccagtacgtcggccaggtcgcgccccgcgtcgtccgcgaggacgtcccgcacctcgtcgaggctgagcccgagctcggtcagccggcgtacgcgggccagcaggacggcgtcgcggacgctgtaggcccggtatccgttggggcgccgctccggttccgggagcagcccgacatggtggtagtgccggatcgcccgggtcgtgaccccgacgagcgcggcgatctctccgatccgcatgacttcagtagaaaccttgccgccgcgtcaaggtcaagcgtgtgcgcggcgccgcggcgccggctcggcgacggcgccgcgcggttcctgcggtgggggcggcgacgcgccgcccccaccgccttcacccatcggtccgaagcgcgaagtcgatcccctcccgccgcagctcccccagccactcctccgaccgctgcgccgtctccgccgcgcggttcaagccggccggcaggtcgccgtcgagtacgtggcgcacccccagccccagtgtgcgggagacgcagcgggccatcgcgctctcctccggggtgccttcgaggtccagcaggtagcggcccgaccaggtcgcccccgtgccgctccgcacctccagggacacggcgagaaccacgcggtcgcggtcctcctccgtcgtcgggtacgtcgtggccagctccgccgcgagcgccgcgatgcgctcgtcgtcacccgctttcagttcctcgaagaccgcgccccaggcccgcagccagccgtcgagccggagggtgccgcggacgaacgtctgcggtttccaggcggccggcaggccgtactggccgatgaagggaacactgtcccggttggggtagacctcgaaggtctcgccgtcgacgacatggggccgcgtcgcctcccacggccggtccgtcgtcgtctcggccccgtggtcgaggtaacgcgcgggtgagcgcagggcgttgagcactcccgcgggtgcccagctgaagcggtacttgaagtcgttggggaccgccgggacgccgccgcagtacgacgtcagactcacctccgccgccgtttcggatccgatcgcctcctgggcccgtgcgatcagactgtgggcgaacaggtggtcgatgccggggtcgagcccggcctcggtgagcacgacgacgcctgccgcggcggccgccgggacctggtcgagcaccgcgtccgacacatagctggagcaggcgaagtgagcccggccctggacgcagagggcgagcagcggggcgtgttccggggcgggcagcatggagaccaccacgtctccgggtgcgagctcggccgccagcgcggggagcgtgtacgcgcggggctcggcgcgcccggcgagccccaggtggtcgagagcctgtgccgcgcgctcctcggtgcgatgccacagccgtacgcggtcggcggcgacgcacacggccgcgaggccgctgcccgtggacaggcccgcgccgatccagtggacggtaccgctcgcgggaaccgggtcagacatcgcggacctccgtgtcgtcggtgccgagttcgatgccgagttcacggcaggcctcgtggaagcggtccaggcaccgtccccacggtccgccggaccgtaccccgggtccgccggaccgtccccgggattcagcggtgccgaagtcgagcagcgacggcagcagtgccgccgagaagtccgtgctcgcctcccggggcagcagggacggcaggttgtcgatcgcgatgaggtcgagcggcggcgcctcgcggaggcggcggacggggtgcgcccagtcggtggtcgtgtcgtagaccggcaggacgttcaggggcgatccgacgtcgacggtgacgtccgcgagcgtccgcagccgacggcccggctcgtccaggtccttgtccgtgaggaacggcgggatcggccgggtggtgagcacggtgttgaccagcaactcgtgctccaggagaaccggtcggtcgagatcgcgcgtctcggccaggtcccagcaggtgggttcgacgccggcctcgccgagggccacgcgggcgccccggccgctgcggcccagggccccgatgaccagcgccgtcaactcaccctcggaggagcggagttccgcctccagctcctccttcgacgtcggccgcagcggggtgccgaggccgccccggtggtggagcacggcgagcgccgcccccaggtatccggcccagtagccgaacgcggccagccggcgtccgtcgtcgtccaccaggtactcgaggtcgaacagggccccgccgccggccgcgaacctgcgcagcagcgcctcggctccgggctgccgcttgtacgcgtgcccgaagaagacatgccggtgaaccagttcggcgggctcgtccgggagttccttgaggccgacgatcacggcgtccggtggcgccgacacccatgagcccgcctcggcgatctcgcagcccaccgcctcgtacgcctcggtcggaaagatccgctgcggtgagtcctccacggtcagccgcaccccgctctcgacgagccgtcgggcgtcggacggtacgacgggcgtgcgccgctcggtcgtacgggactcgtggcgcagccacaagtggagctgggtcatacgcggttgacctccggacgcggcgcgtcggcggcgaaccgctcgacgctcagggggctgatgtcgacgaacggtacgcggtcgaggtacagatcacggatcacctcgccgaccgcgggtccctggaggaagccatgcccggagaagccggtcgcgtacaggaaacgggagcaggaacccgcctcgccgatcagcgcgttgtggtccggtgtgatctcgtacaggcccgcccagccgccggtgcggcgcaggtcgagcagggggggcgcgcggcgttccatcgcctcgcacagccgggggatccagcggtcgtgggtctcggtcgagaagccggtggtctcgtcggggtcggacatgccgacgaggagacccgggccttcggtgtggaagtagaggctgctggtgaagtcgatggtcatgggcagcccgggcggcagaccggtgaccggctccgtgacggcgatctggcggcgcagcggccgcaccggcaggtccaccccgaccatggcgccgacggccttcgaccaggcgccggccgcgcagatcaccgtgccggtcccgatgcgtccgcgccgggtgagtacggccgtgatgtcgtcgccgcgggtctcgatgccggtgacctcgcaatgccgcagcaccttcgcgccgtggcggcgggcggcggccgcgtagccgtggaccaccgactcgggcgtgcagtgcccgtcgtccggtgagaaggcggcggccagcagcccgtcggtggtgatgagcggcgagaggcggcgcgcctcggccggttcgagcatgcggctcggcacacccagggagttctggagccggacccccgtctcgaacgcggcgacctcctccggagtggacagcaggaacagatagccgacccggtgcagcccgatgtcctgccccggttcctccccaaaccggccgaacgcctccaggctccgggcgccgagccggatgttgagctcgtcggagaactgcgcccgtacgccgcccgcggcccgcgaggtcgaaccggaggcgagttcgtcgcgctccaccaggacgacgtcgcgtacgcccgcgcgggccaggtggtaggcgatgctcgtgcccatcaccccgccgccgatgacgaccacgtcggcgtgtgtgttcatgggtgctcccgtggtccgcgggccgcggcgatcacggcccaggccgccgccgcgtcctggatgccgagtccgacgctgttgtagaagacgatgtcgccggggctcgtccgcgcggtgtgccggccggtgaccacggcgccgagcgggatcaggtcgtccggggcgagccgccgctcccgcagcgcgtccaccaccggtcccgcgtggtcggccgcggtccccggatcgtcgacgaccaccgccgcggcccgccgcagcacctcggcgtcgacctcgctgcgggtcggctcgaaggaacccacgctcaccaccgtgcaccccggcgcgagccactcgccgcgtacgaccggcgtcctgctcagtgtgcaggcggcgaccatgggcacttgggccacggcttcctcggcggtgtcgacacccttggcggcgacaccgagttcggcggcgagccgctgggccgcctgctcgcggcggccggggttcgggctccagacgcgtacggacctgaggtcccgcacccgggcgacggcccgcgcatgggcgagtgcctgggtgccggagccgagaaggcccagctcggaggcgtcggcggtggccagcgcgtcgaaggcgacggcgctcgcggcggcggtccgcagtgtggtgaccgccgtaccgtccatgacggccacgagccggccggtcaccgggtcgagcgcgttgatcaccgcgtggacgctggccagacctgcggccgggttcccgggattgacgctgccgaacttggcgacggtcccggtgtccgcggacagccgcgagacgtacgcgaagacgacactgtcgtcgaaccggctggggtacatgatcttgccggggagctcggcggtgccgtcgccgagcgcggtgaacgcggcgcgctgcgaggcgatcgccgcgtcggtgtccagcagttccgtcacgcggcgcgaggagaggtagaggacgtcgtcgtcggtcataccttgctcctatccgctgtcccggccggcgtaccacgcccggcgcgtccgggtgccgcacaccacggccaccgtgcgagaccttctcgccacggacgacggcgaaacccgaaagccgccccgggacacgggacggccggcctcgtcgccgcggaagtggccgcggaaggcatcgccgccggcggccggcgccggggtgggaccggccggccggccgcgcggccgtcgcgtggagcgggccggctcaggaggagcgggccacggcgtccaggtgcggcaggatgtggtcgagccgctcccgcttggtgcgcagataggtgatgttctcctcgcacggcggtatcagcagcggaacctgttcgacgacgttgatgccgtgctggagcagcgactccagtttgcgcgggttgttggagagcaggcgtacggacctcaccccgaggtcgtgcaggatcttcgccgccaccccgtagtcacgggcgtccaccgggaggccgagggcgaggttcgcctccacggtgtccagcccctccgcctggagcttcatcgcgcgcagcttggcgagcaggccgatcccccggccctcgtggccgcggaggtagacgaggatgccgcgccccgcggcgacgatctcccgcagggcggtggtgagttgggggccgcactcgcagtgcctggacccgaaggcgtcccctgtcaggcattccgaatggagccgggtgagcaccccctcctccccggcgccacgcacaccgccgaggcccccgatgtcaccgatctcgccgtacaccagggccacttgctcctctccgcgatcgtggtcgaggtaaccgacggcatggaaatcgccgtacacggtgggcaggggggcattcacgactcgttcgacacctgagagatgcgcagtcccgccgagtacgccaaagttttctgtcatgatctggttcctaagcagagtcgaaaggccgtgaaacatgagtagttcaggatcgcagtcgacggtatccggtctgttgccgcaggacaccacggaggatgtccgggaacgcgggtccggggccgtccggcaggtcgccgtgcttcctgtcggcagcttcgaacagcacggtgcgttccttccgctggccaccgacacgctggtcgcctgtgccatcgcgcgggaagtcgccgccgcgtatccggtccatctccttcctccggtgacgatctcctgctcgcacgagcacgcggcctggccgggaaccgtcagcatctcctccgtcacgctccacgcggtggtccgggacatcgcggactcgctccgccgttcgggggtcgagaccctggttctggtcaacgcgcacggcggaaattacgtactgggcaatgtagttcaggaatccgccggcagcggtacccgtatggcgcttttcccggccccggaggactgggatgcggccagggaacgggcgggtgtacagacctcgctgctcagtgatatgcacgccggggaaattgagacctccattctcttgcacacccatccggaattggtccggcccggatacgagaccaccgatttcctcgtcgacgatcggcggcatctgctcaccctcggtatgtcggcctatacggagtcgggcgtcatcgggcgcccctcgctcgcttccgcggagaaggggaagcaactgctggcggggctcgtcgattccttcgaaccgtatttctccttggtcacctcggaatcggccaccgtgacccccggaacggcggcggcggaccggcaccgttcgtgacgccgtgtcaggagcacctccggccgtgacgggggtgagcgggggtaggaggcgtgcggtgcgggggcacggagcgcgtggggggtgcgctccggggtcgagccggcgtcgggcacaaggtgccgcggccgtccggtgggcgccgccgtttcgccttcggcgtgcgccgcgtccaccgcttcgtccgccacgtccaccgcttcgtccggccgttcggcggtggccgggctctcgtgccgccggtgcttcagggcggcgtaccagcggacgacgagtacgcagatgccgggcaggctcgcgacgaagctgaggacgccgtacacgacggcgacggtcagccccgtgctcgcgccgagcccggccgcgccgaaggcccaggcggtgacgccctccctgggaccccagccgccgatgttcagcggcagtcccatggcgatcagggccagcagcgcgatgggcagcaaccgggcgacggacgcggcggatccggcgacccgcgcggcgaccaggaacatcgcgaggtgtccggcgagcacgacgcacgacgacagcaggacgccgggccagttgcgccggtcgagcagtgcgctccgcgcctcggtgagcgcggcgcgcagggcccggccccgacgggacgggcggggcgcgcggcccatccggatggccgccacgatggcgagcgaaccgagtgcggcgagccccagcagctcggccagatggcggctctgggccagcaccggtgacggctgcgtgagcaggaccggtacgccgatcgccaccagggcgatctggccggcggtccgttcgaagatcaccgcgcggacgccgcggccgaggtcaccggtgctctgcccgtgccgtaccgcgcgatggacgtcgccgacgacaccgccgggcagcgccgcgttgaggaacagggcacggtagtaatcggcgacggcggggccgagcggcagccggatgcccagtccccgggcgacgaggcaccagcgccaggcgctgaacacggtggtcagcaggccgatgccgagcccgatcagcagggtcggggcgtcgatccggcgcagcccgtcgaggaagacaccggtgccgaggcgccacaggagcacgccgaggatgacggtgccggcgacggtcccgaagtgcttacggaccgcccgcgatgcgaaccgggcacgcagccgggtggctcgcgaggtgcggggcgacgcgacgggcgacacggtcacggaggtcgcgccgtccttcggtcgtgcgggttccggcggccgcaccgtggtgagctgcgcggcgtcggtcatcagcggccccgcatccgccggcgccgtcatgacgccccgcccgccggcctcggcagtgccagcaggtccatgtggtgcacgaccacccgcagttcgcccgcggcgcaggcggccagacggcgctgcagatacgtatccgcacgctccgccagctccggtcgctgctcgacggccgccccgacccagccgcgcagccactccgccgccagttcactttcctgggcgccgagtcgccaggcgctcgggttcacccgtacggtcgcgcccagccgcccgaaggcctcgcaggccgcgttgatcgcgtcgggtccgaggaggtcgccccgccgctggtgggtgttgaaggcctcgccgatctccgcgtccatcgggtcggccggggtcagttccacccgtccgacgacggagagcgtcagcagcgccgggcagcccgcgccgacgcaggcctcggcgagcgtgtcgatctcgtcgggggtgaggacgtcgaggagcgcggaggcggtcaccagcgaggcaccggcgagggcgtccggggtgagccgcccgatgtcgccgcgctgggtggtcaccgtgacgcggctgccgtcggcggccgcccggggcgcgcccacggtggcgaagtgcagcagatacgggtcgcggtcgtgcaggacccagtgctgggcgccgtcgagccggggtgccagccagcgccccatggagccggtgccgcagccgaggtcgtgcacgaccaggtccctcggccgccccggccggttcgccagccggatccgcagcgggtcgagcaggtcgtgggcccgcgcggcggcgtcggcgggctcgcgcagttggagccactggggggcgtagcgcggcacctcggggtcggcgcccgcgggcgccggaatcgccggcagcggggcgggcccggaggccgggtcggtgtcagccgctcccgtggccgtacttccgggggaccctgtcggggtggtgctcatgctcatgccgccctccgggacgtgtcgggcagccgggacagtacgcccgccaggctgcgggcggtcgtcgcccagccgtccagcgcggcccgccgcccgcgcgcggccgccttcagccggcgccgtacatcggcctcgccgaaccagccgcgcagttccgcggcgagcgccgccggatcctccggcggtacgaggatgccgggcaccccgccgtcgggcgcgcgcccgaccgcttcgggaaccccgccgacgtcggtggcgaggacggggatgccgcgggccagggcttcggtgacggccatgccgtatgtctcggcgtacgaggcgaggaccatgaggtcggcggcggcgtagctcgcgtcgagttcggcgcccgcctggggtcccgcgaggtgcagccggtcaccgaggccgtgctggtcgatcagggcgcggagccgtgcgacgtactcggggtcctgtccgagcccgccgacgaacgagcaggtccagggcaggtcggtgacggtcgcgagggcctcgatcagccggtgctgtcccttgcgcagcgtcaccgcggcgacgcacagcagccgggagacgccgtcggtgccggaggcgaggggggcgatgtcggcgccgggggcggcggcatggacgcggtcgggggcgagcccgtggtgggagacgagccggcggaccgcccagtcgctggtggcgacgaccgcggacacggcacgcagggtcgtgcgctccagccggtcgagttcggcggcgacggcggggtcgagcccggtctcgtcacccaggggaaggtgcaccagtacggccagacgcagccgttcggcctcgggcacgacgatctcgggcactgggcaggcgacgagtccgtcgagcaggacgaccgtgccgtcgggcagttcccgcagcgtacgggcgagttcggcgcgggcgtccgcgccgggccggggccagctgccgtcgaccaagtgcttgtggacctgccagccgaagccgggcaggtcgaggcagatccggcggtcgtaggcgttgccgccgctcggcatggccgggtcgtcgacgccgccgggcatcacgaagtgggcggtgcgcagggacatggggatgatctcggcgttcttgagagccgcgtgctgcacgggcacgtagttcagggctgcctggtcgacgaccttcgcggccgtctcgcgggcggtgttcatggtgttcgtcgatgtccgctcgacggtcgtgtcagtcacagagcacgctcgtaactcgcccaggcgatgtgcgactcgtgcagcgtgaccgagatgcccgccaggccgcgggcgccctcgcccagcgctcccttgtgcacgcgctcggcgagccggtcggcgatgaccttggcgaggaactccgtcgaggtgttggtgtgggcgaagtcgggctcgttgtcgaggttccggtagttcagctcgctcaccacacctcccagctcctgtgtggccagtccgatgtcgacgacgatgttgtcgtcgtccagctcggcgcggcggaaggtggcgtccacgaggaacgtcgctccgtgcagacgctgcgcgggtccgaagacctcgccgcggaagctgtgggcgatcatgatgtgatcgcggacggtgatgctgaacaacggacgaccctccaggtgcggtgcgtctgactcccctgccggggcatgccgtgtagtacggctgacccgtacgccttgttcatctgctcgttctccttgtttcgaaggttcctcatgaatccttgtgcggatccgatgcggcttcgctccggggacgggcagctcgcgtgggggtcagccggcgtcgtacagaactcggtggcacaaccccgcaagctcaccactggcaagccgtggcagcacgtcggggagttcttcgaaggcgcactcgccggtgacgagcgcgtcgaacgcgggttcggcgagcagttcgagggcgagcgcgagccggtcggcgtacgtgcgtccggggcgcccggacggcgacacggtgccgacctggctgctgcgcacgacgagccgccgggagtggaaggcctcgccgagcggcaggctgacgcgccggtcgccgtaccagctcatttcgaggacggtcccctccggggcgaggagttcgagggaccgggtgagccccgcctcggtggcgctggcgtgcaccaccaggtcgcactcgccgagggcgtcctcgggcagggcgaagccgacgccgagcgcgcgggcgatgtcggcgcgcgccgggtcggcgtcgacgagctggacgcggacgccgggaaagcgggcgaggagcgcggcgacggaacagccgaccatgccgccgccgaccacggcgatgcggtcgccgacgaggggcgcggcgtcccacagcgcgttgacggcggtctcgacggtgccggcgaggacggcccgggcggcgggtacggcatccgggatgacagtgaccgcggaggcggggacgacgtaccggctctgatgcggatagaggcagaagacggtccgcccgacgagctcccgcggcccgtactcgaccgttccgacactcaggtagccgtacttcaccggcgccgggaaatcgccttcctggaagggcgctcgcatggcggcctgttggctctcgggtacgccaccgcgaaagacgagggtctccgtgccgcggctgacgcccgagtagagcgcgcgcacgagcacctcgccgtcggcgggcttgtgcagctccacgtcccgcagctcgccgtgtccgggcgagcgcagccagaaggcgcgtcctgtgagttccatatgcgtcctcctgaacgatcgggcggcccgccacgtacgcagctatgcgaagccgcgcacaaggtacgcggccttgatccaatctgtcacttggccggagggtgagcggtggccctgaaccacacatacgacgcgaggcttttgcagcaggagacgaccgtgggagcgggcgtgcagatcctgttgctggccttgttgggctcggcgatcgggatgggcccggcgggctggctgacgggcctggcgttcgcgctcgccacctgggcggtcctgacccgcgccgtgctccgctcgcgtctgcggtcgttcggcctggccaaccgggtgacgctgggacgcgcgacgctggtcggcggcgtcacggccctggtcgcggactccttcgagagctcgcccccgatcacgctcttcgtcgggctgacggcggtggccctgatcctcgacggcgtggacggcaaggtggcccggcacacgggcacgtcgtcggcgctgggggcacggttcgacatggaggtcgacgcgttcctgatcctggtgctgagcgtgtacgtgtcgatgtcgctgggtccctgggtcctgctgatcggggcgatgcggtacgtgttcgtggcggcggcgcgggcgatgccgtggctgaacggggagttgccgccgagcacggcgcgcaagacggtggcggcgctgcaaggggtcgtgctgctggtggcgggggccgggattctcccgcaggcggtgacactcggggcggtggcgctggctctggggtcgctggtgtggtcgttcgggcgggacatcgggtggctttggcggacgaacgcccgtacggcgtgacccggggacggcggcccggcccgaggatcggcgcccgcggccctctcgggttttccgccgggcgcataccgcggaccacggcgttcacgacggtcgggacggccccgcccggttgcgggcggagccgtcgtcatggctagcggaccggtgtccgccgggacgccgtgctcagtgccggggcgtagccggcgggccgggtggtgaaggttccccggccccgggtgcggccgcgcagccgggtcgcgtagccgaacagctcggccagcggcacggtggccgtgatcaccgacgcgcccgctcgcgtcgtcgagtccgagacccggccgcgccgcgccgccaggtcaccgagtaccgcgcccacggcgtcgtcgggcgcggtgaccgtcacttccgccaccggttccagaaggagcatcgcgctggcgcgcagtgcctcccggagcgcgaaccggcccgccgtccggaacgccatctcggaggagtccttcggatgggtcgctccatcggtcaggacgactctcagcccggtcaccgggtgaccgccgagcgggccctcggccagggcgtcccggcagccggccgccaccgcccggacgtactcctgcggcacccgcccgccgacgacggccgagcggaactcgaagcccccgtggccgccgtcggcggcggactccagcggctccacgtcgaggacgacatgggcgaactggccggcgccgccgtcctgtttgacatggcggtacacgagcccggacacgccgcgggcgaccgtctcccggtaggcgaccctcggccggccgacattgacggccgttccccggtcgcgccggatcttctccaccgccacctccagatgcagctcgcccatgcccgacagcacggtctggccggtctcggggtcggtccgcaccaccagcgagggatcctcctcggccaggcgcgccagcgccgaggccaagcggtcggtgtcggtgctgctgcgcgcctcgaccgcgacggagacgacgggatcggcgacggtcggcggttcgaggaccaagggagccgcgggtgcgcacagggtcgacccggcgcgggcggtcttcggcccgacgacggccacgatgtccccggcgaccgcccggtccagctccgtgtgacggtcggcctggacacgcagaatccggccgatccgctcgctgcgccgcgcgccggtgtccagcacggtctctcctttcccgatcgttcccgagtacacacgcagatacgtcagccgccctgtcgcggtcgcggtcaccttgaacaccagggccgcgaacggcgccgccgggtcggcggcccgttcccgcaccgcgccgtcctcggtgccgcgtacggccggtacgtccagcggcgagggcaggtaggccacggcggcagccagcagcggttcgatgccgcgattgcggtaggcggagccgcagagcacgaccacgccgtccccggtacgggtcaggtcgcgcagcgcgcgggtgagggtctgtgcggagaccgtcgcctgcgcgcagaactcctccagcgcgacgggatggagttccgccaccgcttcctccagctgccgtcggcgccggtccgcttcgtcccgcagggcgtccggcaccggcccctcctcgacggtgtcccgcccgtcggcccagagcagcgacctcatgcgcaccagatccaccactcccctgaacccgtcctgggtgccgatcggcaactggacgacgagcggggccggatgcagccgctgccggatcgactcgaccgccgtgtcgaggtccgcaccggcgcggtccagcttgttgacgaaggcgatccggggcaccccgtggcgatcggcctgccgccatacggactcgctctgcggctcgacgcccgcgacggcgtcgaacaccgcgatcgcgccgtcgagtacgcgcagggagcgctccacctcgtcggagaagtcgacatgcccgggggtgtcgatcagattgatccggtggccgtcccagtcgcagctcaccgccgccgcgaagatggtgatcccgcggtcgcgttcctggggatcgaagtcggtgacggtcgtgccgtcatggacctcgccgcgtttgtgggtggcgccggtgagatagaggatccgctcggtgacggtggtcttccccgcgtcgacgtgggcgaggatgcccaggttacggacggcggtcagggggctgttggggtgacggtgcgagtcggtacgcacggcgcatggcctttcgggacggtcgggaacgaccaggtgatccagaacggggcagcgcgatttccgggcgacacgggcctgctcggctcgccgacgggcggccggcacacaggagttgtcgcgtgcgaggggcccggcgaggtcaggtgttcgtcacggacatccggtggcggccgcgcagccggcaccgggcggacgaagacacgaggatcacctcgtactgcgaccggggaacgacgacagcgatgcggtaccgcacggccgggctcccctcactcgtcatggcgcacgccgcgacgtgttgtcggcggcgcgcggttcgtggcgagtgtagggaacccggcgtgcgcggggcaccgggtttttctccacgtcagtggcgcgcgctcggcgtgacgactcccggtcccacgcctgacgtcgcgtcaggagcacatgtgaccctcgtcgttcacttcttctgctcgacgcgcacccagtccacctccgcctgcactcccccggccgcgaccttgtcgacgctggtctgcggcaggccccagtaggggctggtgacctggttccagcccgccgggtacgcgccgccgagggcgaggttgaggatgacgtactggttgtggtcgtagacccactgtccgcgggtcgattcgagcttgttgcgggtcgtctcctgcacgagacggtcgtcgaccgtgaagcgcatcgtggtcggcgtccactccaccgcgtaggtgtgccagtggtcggccgtgccgccccccgggtatgtctggcgggcgcctatgttgccgtccgccgagtagccggggccgtgcagggcggagctcgtccagtccgagtagccgatgttctccatgatgtcggtctcaccggaggcgggccaggacacggacggatcgtccacgttgctgcccagcagccagaacgcgggccagaagccgtcgccgaccggcagtttcatacgggcgctgacccttccgtacgtgaagtcgaacctggtgttggtgtcgacgcgtccggaggtgaagtcgtaggtgccgcctcccgcccgggtgcagcccttgcagtacttggcccgcaggaccaggttcccgttctcggtgcggacgttgtcggtggagtccacgtacgcctgcgactcgccgttgaccgagcccatctcggtgccggtgcgcacgacacgccacttggagcggtcgagggcggccgtggtgaagtcgtcgaagaacgcggtctggtacgtgcccgactgctcgcccgggagtgcgggataggccgcggaggcgctgccgccggtgccccagacctggaactcgtagagggagtagccgaattgggccgtggcgggtgcggggttgtagaaggagcggcgctccttgccgagcatccgtacatagcggccggtggcgggctgcgacagcgtcaccgtgtcgtgccggcccgtcgcgtcgccgggtgacttgacgtccgcgcggcgggcggcgatctcggcggcggtcggctggtggaccgtacgccaggtgcggttgtcgtccgagacctggatctggtagtcgacggcgtaggccgcctcccagtacaggtcgacggtgtcgatccgcgaggtcgcgcccaggtccaccgagacccagcggtcggcgttccagtcgctggaccatctgctcgcgtcgtccttgaagttggcgggccatccgccgtcggtgacgaaggcgggtgaattgccggcgtgctggtagaagttggagtaggccgggtggttgagggcgaggttggtgcgggtcgtcgacgcgggggcgggttcaccgccgtagaccttgaaggagtagagggagtagccgtagggcgtggcgcgttcgacgccgcgcatccggacgtagcggcccgtcacctcctgtgggtaggtgtgcgcggtgacggaacctccggtgccggcggtctcggtgtagaagggggcccagtcggtgccgttcttcgacacctccaggacgtatctcttgccgtacgcggtctcccagtcgaggacgactctgtcgatgcggagggtggtgccgaggtcgaggcggatccacgcgtcgtcggcgaaattgctggaccagcgcgtcgaggcgttgccgtcgaaggcgaggccgggcgcggtgccgccgttctcgctgccggaggcggtgaccgcggccgggttcgcggcgtaggcggcggccgcccggtcggcgtcccaggccgcggcggcggtggcggtggcttgcggtacgggcgcggcgagcgccgggcccgtggacagcagcgccaccgacgcgacggtggcgagggcggtcagcagcgtgcggggggtacgggatggcatacggctctcctcggcgaggtgtggggtgcccgtgccgtgctgtgctgtgccggtgtgctgacgtgcttgtagtgatgtccctgtgtgatgtgtctgcgagctgatgtgcctgcgtgctgatgtgcccgtgcgtgatgtgcccgtgtgccctcgtacgccggtgggcgcgggctcccgcgcccgcgcccaccgcggggccgcgcgtcaggcggcccggcgcgcccggccccggtgggtgcggacgatgtccgcgtagcgatggccggttcccttgatcgtccggacctgggtgcggtagtcgacgtggaccaggccgaagcgcttgtcgtagccgtacgcccactcgaagttgtcgagcagcgaccacgcgaagtagccggccagcggcgcgcccttgcgggccgcggaggcgcacgcggccaggtggcgtacgaggtagtcctggcgttcggggtcgtcgacggtgccgtcggggcgtaccacgtcggggaaggcggagccgttctcggtgacgtacagcttgcggggcccgtactcgtgggtgaggcgcagcagcagggtctcgatgccggtggcgtcgatctcccagtccatgccggtgcgcgggacgccgagccggcggaccgagcggacacgcggagccggtccggtggggtcgtcggcgacggtggccgggaagtagtagttcaggcccagccagtcgagcggcgcggcgatcgtcgccaggtctcccggctgctcgggcagttcgacgccgtacacctcgcgcatgtcggccgggaagccgcggccgtggaccgggtccagccaccagcggttgacgtggccgtccatgcggcgcgccgccgcgacgtcctcggggcggtcgctggcggcatggatggtggagaggttgttgacgatgccgacctcggcggccggggccgcggcgcggatcgcctgggcggccaggccgtgcccgaggagcaggtggtacgaggcccggatcgcggcggtcaggtcggtgaggccgggggccatcttgccttcgaggtggccgatccaggcggagcagagaggttcgttgagggtggcccagtgggtgacgcggtcgcccaggcgttcggcgacgaccgctgcgtacgcggcgaagtgctcggcggtcgcccgttcgggccagccgccgcggtcctggaggacctggggcaggtcccagtggtagagggtgacggacggggtgatgcccgcttccagcagaccgtcgaccaactcgtcgtagaaggcgaggcccttggcgttcaccggcccgtcgccgcccgggatcacccgcggccaggcgacggagagccggtaggcgttggtgccgagttgcttcatcagcccgatgtcctcgcgccagcggtggtagtggtcgcaggcgacgtcgccgtggtcgttgttgtcgatcttgccgggggtgtgcgagaaggtgtcccagatcgacggcgagcggccgtcctcggcgacggctccctcgatctggtacgccgctgtggccgtaccccacaggaagtcgtgcgggagtgcggcgaggtcgatggtcacaggattcccttcggaatggggggagtcggtcacttgacggctccggccgtcagcccggcgacgagatagcgctggaggagcaggaagcccgcgaccacgggaacgctgacgacgagcgaggcggccatgatctggttccagtacacgttgttgagcgtggagtagccctggagtccgacggcgagcgtgcgggtggtgtcgttggtcatcaccgacgcgaacagcacctcgccccaggcggtcatgaaggcgtagacggcgaccgcgacgatgccggggatcgcggccggcacgacgacccgcaacagcgcgccgagcggtccgcagccgtccaccagcgccgcctcgtccagatcgcgcggcaccgagtcgaagtacccgatcagcatccagatcgagaacggcagcgagaaggtgagatacgtcaggatcagcccgccgcgcgagccgaacagggcgatgccggtggagttgccgatgttgacgtagatcaggaacagcggcagcaggaagaggatgccggggaacatctgggtggacagcacggtgaccgtgaaaacgcgcttgccccggaagtcgtaacggctgacggcgtacgcggcgaagaccgcgatcaccaccgagcagaccgtcgcggcgcccgccacgatcagcgagttcacgaagtaccgcgcgagcgggaccgtggaccagatgtcgatgtacgggcggatcgtcaggctgctcggcagccaccggaacttccccgagacgtccgcgagcggcttcagggagctggagaccatgacgtacaccggcagcaggacgaagccggtgagcagggtgaggaagatccggcgggaccagaggaaggaccggggcggagccatcggcgagcgggccgtcgaagaggtgctagacatcggccgtcttccttcctcgggaggtcagcaggaggtagacgcccgtcacgacgagcaggaagagcagcagcaggacggacatggcggagccggtgccgaagttccaggtgacgaacgacgcctggtagatgtggaccgagatgaggtccgcggcctccggcgccgtcctgccgaacaggacgtacggcgtgttgaagtcgttgaacgtccacaggaacaggaccaggaccaggacctggttgaccgggcgcagtgacggcagggtgatgcggcggatctgctgccacaggccggccccgtcgagggcggccgcctcgtacagctcgcccgggatgttctgcaggccggccatgacgatgaggaaggcgaacggccagcccttccacacggacacggtgagcagcgcgacgaagctgttgtcgccgatgagccagaaggacggcttgtcggtgaggtgcaactggtcgtgcaggacgtggttcaccaggccgttgtcgtgctggaacatgaagacccaggtgatgacggccgcgtacacgggcagcgcgtacgggacgaggaacagggcgcgcagcaggccgcggccgcggaaggtgtcctgcatgtagatcgcggccgccgtgccgatcagccagcacaggccgacggacagcagggtgaaggcgatggtgacgaggaacgagtggagcagcgcctcaccgacgggcgcgtcgaagtccaccgacacctggtagttgtcgaggccggaccagggcgcggtgccccagtcgcggatgtagaactgcgtgagctccttgaagctcatcacgatgccgatgaccatcggcaccaggtggaccaggagttcgaggagcagggcgggcagaagcagcaggtagggcagtccgatgcgcttgatccgcccggtgcggcgcgggccgcgcgccgcaccgggggagttcttgcgcaccgtccgctcgccggactcggcggaggcggtcgtggtggtcatgacggtctctgcactcacttcttcggcatctgctgctgggccttctcgagcttggccttcaccgacgccgtggtcaccgcgcgtccggcggccgcgtcggcgaacagttccttgacggccgtaccgatggccgtctcgaactgggactcgtcggcgacctgcggaagcgcgacggcgctcttggcgagggtgtccttcaggaccgcgttcgccggggtgttgaaggcggcgtccgcttgggcggtcttgaccggcgggatcgtgctgtacgccgtgttgaggatcttctgctccgcgtcgccggtcatgaacttcacgaacttcgtggcgccgtcgaggttgtgggtgttcttgaagacggccatgttgatgcccgcgaccatcgagttgacgttggtgccgcttcccggggtgccggactgcacgggcatcggagcgatgccgtacgcgtcgtcgctcatgccctgcgacttgaggttggaggacgcggactgccacagcagcatcgcgttcttgcccttggcgaagtcgctcacggactggttctgcgcgtactcggcgttgccgggcgcgatgatcttgtccttcgccatcaggtcgacgtactgcttgaccgccgtgaccgcgccgtcggaggtgaagtcgggcttgccgtcggcggtgaagaagtcggcgccgtgctgcttggcgaagacgaaggtgtggtggatgttctcggacgggttcgagccctcggctccgaggccccatgtgccgcccttggagagcttcttgccgtcggcgatcagctcgtcccaggtggccggcggcttggcgatgcccgcgtcggcgaacaacttcttgttgtagtagagcgcgtacgccatcgagtacagcggcaccgcggccgggtccttgccctgggcgccggtcgagccgagggccgagtcgacgaaccggtccttgccgccgatcttgtcgaagttcttggcgtcccacggcagcagcgccccggtggcctggagggaggcgctccaggtgttgccgatgttcagcacgtcggggccctggcccgacgtggtcgcggtcaggatccggttgagcagatccgaccagggcacgacctccaacttcaccttgatgcccgtctgctcctcgaacttgtcgagttcgggctggaggacctttttgtccaccgcgatgctggcgccctggttggaggcccagtacgtgagcgtcttgggcgagtcgttggatcccccgccggtcgacgaaccgcctccgcaggccgaggcggcaagggcgagagacatggtgacggcgcctacggccgcggctcggatgctgcgcatggctccaggtgtccctttccgggagtcgagaacccgaggcagctccggaacgacaccccgttcgacttccgaagcccctcatggcttaatttagaacgtgagttaaacctcgagagaaagaagcgtcaagagatccggcacgggtatcttgccgagcgacgtaggaaaatcaggaggtcaggtggcagcgcgcaacggccggacggtccatgacctgcgacgggagaaccgcaccgccgttctacaacggttgtatttcgacggaccgatgagccgccactcgctcgcgcccgcgaccgggctgagttcgggttccatcagcaacgtcgtcgccgaactgctggccgacggtctggtggaggaggcgggcagcgtcggctccgacggcggccgcccgcgcaccctgctgcgcgtcgtccccggcagcgggcacatgatcggcgtggacgtcggcgagacccgggtgcgcgtggagctgttcgacctctccctggcggaactcgcccgcaccgaacgcccgttggcgcacaagggccggcaggcgtacgacgtgggcgtcatcgtcggtcacatccgcgacggcgtcgccgaggtcctcgcggcagccgggatcaccgccggcgaactcctcggcgtcggcatcggcgtgcccggcatcgtcgagcgttccggcgagggcggcgcggtcgtccacggtcagacgatcggctgggacgccgtcccgctggagcacatgctgcgcctgtcgggtcaactccccgagcatgtgccgtacttcatcgacaacggcgccaagacgctgggccaggcggagatgtggttcggcgccggacgcggcgcgcacaacgccgtggtggtgctcttcggatccggtgtcggcgcctgcgtggtcacggacgaggtggagcacggccgggcggtcgaatggggccacctcaccgtacgggtgcaggggcggcggtgccgctgcggggcgctgggctgcctggaggcgtacgcgggcgccgaggcgctcctcgcgcgctggcaggaggcgggcgggcagccgccgtacgacaccgacgaggagaccgcgctgacggcgatgctggcggcggcctatcccgaggacggccgtgcgccggacccggtggcggcggccgtcctcgccgagaccgcggagtatctgggcgcgggcctgtccgacctgatcaacctcttccagcccgaacgcatcctcgtcggcggctgggccggcctccaactcggctcgcggttcctggagtcggtacgcacccacgccctcgcctacgcactgcggtaccccgccggacgcgtcggcatcgagctgggcaggctcgggccggacgcggtgaccgtgggcgccgcgatcctgccgctcgccgacttcttcgcccacggcggccgccgcgcacccgcacccgacgcacccgtgccgtctcctgcgtggcgtacgtcgctggacgggcgcctggcgtaacgcgctgggcgggcgtatgtcgctgggcgggcgcctgacgcaacgcgcagaccgaacgaacgccgctgggcgcgcagcctgacgcaacgcaccggatcagcggcttctttcgcgcacctcttgaacacaaggatcgcggtaccggatgcgccgcacacctctcattacctgcccaactagccccaaatgaccgccggttgacggttattcttcaacaacacgcgggactccggtcccaactcttgacgcgtcgttcacgcggatgaagcattcaacggcgagagagcgctccctcctccccctcgtcgttcatttcctgaaccaggagagtgcccgcatgtcccctgcccccacaggttcttcggcggagcggccttccatagcccgccggacggtgctcggcgccgctgccgccgccgcttccgcgcccgcgctgctcggcctgtccacgccggcctccgccgccccctcctccgccgccccgcgcgccctgccgggcggtggcgacctcggcccgaacgtcatcgtcttcgacccgtccacgtccggcatccaggccaagctggacgaggtgttccggcagcaggaatcggcgcagttcgggaccggccgctacgccctgctgttcaagccgggcacctacaacgggctcaacgcccagctcggcttctacacgtccatcgcgggcctcggactgtcccccgacgacacgacgatcaacggcgatgtcaccgtcgacgcgggctggttcaacggcaacgccacccagaacttctggcgttcggcggagaacctcgcactggtccccgtcaacggcaccaaccggtgggccgtcgcgcaggcggcgccgttccggcgcatgcacgtccgcggcggcctcaacctctcccccaacggctacggctgggcgagcggcggctacatcgcggacagccgcatcgacggccaggtcggaccgtactcgcagcagcagtggtacacccgcgacagcgcgatcggcagctggctcaacggcgtctggaacatggtgttctccggcgtcgagggcgcgccggcacagagcttcccgaacccggtgtacaccacgctgaacaccacccccgtctcccgggagaagccgttcctgtatctgagcggcagtgagtaccgggtcttcctgccggagaagcggaccaacgcccggggcgtgacctggggcaacggcacaccaagaggcacctcgctgcccctgtcccagttctacgtcgccaagccgggtgtctccgcggccaccctcaaccaggcgctcacacagggactccacctgctgctgaccccggggatctaccacgtggaccagccgatccaggtgaaccgcgcgggcaccgtcgtcctcggcctcggttacgccacgctgatccccgacaacggcgtcacggcgctgaaggtcgcggacgtcgacggcgtacggctggccggcttcctcatcgacgccggcccggtcaactccgccaccctgctggaggtcgggccgcggggcgcgagcacggaccactccgccaacccgaccaccgtgcaggacgtgttcgtccgcatcggcggggcgggcgcgggcaaggccaccaccagcatggtgatcaacagccgccacacgatcgtcgaccacacctggatctggcgcgccgaccacgggaccggcgtcggctgggacacgaaccgggccgactacggcatcgtcgtcaacggcgacgacgtgctggccacgggcctgttcgtggagcacttcaacaagtacgacgtccagtggtacgggcagcggggccgcaccatcttcttccagaacgagaaggcgtacgacgccccgaaccaggccgcgatccagaacggctccgtcaagggctacgccgcctacaaggtcggcgacgcggtgaccacgcacgaaggctggggactcggcagctactgctactacaacgtcaacccgtccatcgtgcagcaccacggcttctccgccccgaacacaccgggcgtcaagttccacgacctgctggtcgtctcgctcggcggccagggccagtacgagcgcgtcatcaacgagacgggtgcgccgacgtcgggcacgtcgaccataccgtcgacggtggtgtcgtatccctgatgccgccgcgccgtgtgcgggccgggtccgtccccggcccgcacacgaggcgatcagcaggtgggcacgccgggcagccaggccgggcccttgatgtagatgttcgtcagccaggagccgtcggtgagcttggaccaggcgtcgttggtgtagccgtcggccgtcacctcctgggcatgggcctggcacaccacgttgaccgtggtcggctgcgcgaagtagtcgaccacaccggcgttgacgtggggttcgctgtgcgtgcgcactccggttccccaggtctggaacgccttgctgccgctggtgggcggcggcgtggtgctgccgccgcagtccggcacgccgggcagctcggccgggcccttgatgtagacgttcgtcagccacgagccgtcggccagtctggaccagatgtcgttggtgtagccctccgcggtgacggtctcggcgtgctgctggcactggaccgagacctgggtcggaccggcgaaggtgtcgacgacggaggcgctcacgctcggcgtggagtgggtgcgcacactggtgccccaggtctcgaaggtcgtaccgccgttcgcgggcggcggcggaacggtgcccgaggggttgatccggatcgctcccgcgtagtcgccgccggtgcgggcgggggcgaccctgatgtgggtgcccgactcgtacgcctcgaccatctgcccgccgcccagatacatggcgacgtgatggatgtgaccgctcccccagaacatcaggtcaccgggcagcagcggaccggttccctgccccgccgagaagcgggcggaggcctgcgagctgtggaactggtcgttggacgtgccgttgagcaggtccttgccggtcgcccggtagtacgcgtaacggaccaggcccgagcagtcgaagcccttgcgctcgccgtcgtggaggctgtccgggtccacgccgtcgtagtagccgtacgtggcgccgggcgtggcgccgtggccaccgccccagctgtaccagacgccgatctgggcgcaggcggcatcgacggccgcctgcgccgtggccgaggcacccggcgccagcacaccgcaggtggcgtcccgggccgcggcgggtgggacggagacggccgcctgggccgtggagggaaggaacgcggtgagggccaccgccacggcggtcacgaccgcccggccgatgacccggcgcatggtgctgatcttcaaggagtacatcctttgtcgacggtgcgtcaccgaggaaaccggtgacggaaggtggcgatatgcgcgagagaggagtgacccacgtcactttctggaattcggatggtccatgcccgtgccgcgccccctcccctgcaaggggcgcggcacgggcggctcttcacgggagacggcgtcgtcgccctctgttccgcaggcgccgagcgcggcgcgcatcttggccagcgcccgcatccggttgcgctggacggtgccgcggtgggcgccgagccgctcaccggccgtgtcgtggctgaggccctccaggtcgatgaggatcaccgcggccgcctccttcggcgacagcacgcgcagcagcgcgagagccgtggcggacgcctcgtacgaaccgaggccgccgtcccagcccgcctcgggcagccggtccgtggtgcgctcgcggcgggaggggtgcacccatgagtcgcggagcaggttgaaggcgacggcgcaggtgtacgcgtacgggtgctgctgacgtgccagggtctgtgcgcgggcccggcgcgagagccgcaggtaggtctcctgcaacagatcgtcggcatcgtgcgcgttgccggtcatcgccagcagccgccggcgcagccgcggcatggcttcggtgaaggacgcgtcgaactcccgcgggctcatacggtcgccctggtacgggaccgccgcacacgtgacgtcgctggtctccatgcttcttctccccgttctttccgctgtgcggttgatctggttcgcctgtgctcgcgctcccggcgtcgccttgtgctcgcgcaccccccggctggtcgcgcctgccggtgcgcggcacgtcatgccgtcggtgtcgagccgcccgcccggagcccgggcggcgcggtggggccgtagcgggcggcgggcgcccggcgcagcagggcccagtaccggtcgccgtacgaccagtgccaccactcggtggggtagttgacgaacccgaccgccgtgagggccctgtccatcacggcccggttggcgcgtgcctcgacgctgatgttcggagccgcggtgcggcaggcgccttcgctttcctccggggtggcgttgacctccgtgccgagcggcagctccgtgccgtccgcaccgcacagcgtcagatccacggctccgccgctgacatgcggtgcgacctccggcggcgatatgtacgcgctcgtcagctcacggatccggtcgggcgcctcgtccgggtgggccgcgcgcatcgtcgccgcgtactcctcgaagtagcgtcgctggagctgcggcggccggtacccctccagcaccaggaaccggaccccggtgggcagcaaccgctgtgcctggaggagccgccgcagtgcgccggcccgcagatgggcgtaactgccgtcgtggtccgcctgtcgcgcgtcgagtcgcagctcggcgacctcacgcagatcgaccagtggttcaccgcattcgtcctcggcgacgccggcgactcgggcgtccgagagcgggatgatttctgtcacgcgacgagcgtggcccagggccctgcaattgctctgcaggttctctgcaaggagcgggacagggcatctccagagggccgaggcggcacgtcaacggcgggacggcccgcggacggtcctggggctcacctcgtcctacacgcctttgtccgcgcgctcccgcgcctcccggctgtccagcgcgcggaaggtctccagcgcctgcgcgcgggctgcccgcgccgcctgttcgtcgcgcgcgacgccgacacctcggccaggtcccaggccgtacgggccccccacagcggaaggtccaacgcctcccaggccgccagcgcccgctccagtggctcccgcgcgcgctcggtctcgccggccgccagacaccactcacccagggtgcgcagcacgagtgcctcaccgaaccggtcctggcgctcgcgggccacctccagacaccggccgagccgctcgcgtgccttctccaggtggccccggcgcagctccaccttggccaacgactgctcggtgtacatcacgccgaaggtgtcctggagaccgacgaagatccgcagcgcctcgtgcagcagccgctcggcgtccgcccacgcgccgtccgcccgacggcacagggccagcgaacgcagggtgagggcctcgccgtgccggtcggacgcggtgcggtacagaccgagagcccccgacagggcctcccaggcctgcgccccacgcccctgctcacggtgcacgtagccgattccgtacagcacgcgcgccctggcgccgacgtcgtcggtctgctcgtaccgctccagtgcggaactcagcagctgcaacgcctccgcgaagcgggcctgttcgcgtcgcgcggagcccattccggcgagggagagggccgcccctcgcggcacgtcgccgcgctcgtcgaacaggcgcagcgcgtcggcgaagtaggcgtacgactcctcgaacttgtcctgttcgtagcgcagttgaccgaggcccgtgagcagccacgcctcgccctcggtgtccccgccgcggcgtaccgcctcgagggccgcggcgtgcgagcgcgaccaggcgtcgaactggttgtacagcacggccgaactcgctatcagcgcaccggcgagatcccgggccgcacgggccatcccttggtcggcgcagtggaccacggccgccagcagacaggcctgctcggcggcgaaccaggccgcgggccggtccagcagtccctcttccgtctcctggtcgagcagtcgtaaggtccccggctcgggaaagtaccgggccgctcccccgggcccccgggccgccgctcccttggccagccccagccagcaggccaccagccgcagcaccgccgcggcaccgccgcggcacgctcttcggcgctctcctcggacagacatcgttcccgggcgtgctcgcgggcgaggtcgtggatgcggtagcggttgcggccggtcccgtccacgccgagcacatcgatgaagtggcagtccaccaaccgctcgacggcttcctcggcctcctccgttcctatgtccagcaggggtgcggcgatccacgcggcgaagtcgggcagctccatcagcgccagccggcgcagtgcccgacgctcctgcggatcgaggtccgcgtaacccagttcgagactggtacgtaactccaaatcccccgcgcgcagttcgttgagccgtcgccgctcgtcacgcagccgccccgcgaggcggccgggagcccagtgcgggcgcgccgcgagccgggcaccggcgatgcgtaccgccagcggcagccgtccgcacagggtgacgatctccgccacctggtccggctcggaccgcgtccgctcctcccctgccacccgcttcagcagttgcagcgcctccggctcgtccggcacggtcagatccagatgtgccgcgccctccagcgccaccagccgtcgtcggctggtgaccaggaccgcggaaccggggccgggcggcaacagcggccgcagatgcgtctctcccgccgcgttgtcgaggatcagcaggatgcgccggtgtgcgacgtgtgtgcggtacagcccggtcaggtcgtcgattccgttcggcgacgtctccggatcgatgcccatggcccgcagcagtctggcgagcgcgtcggcgggctgcaacggcgcggtgtccgaggcgcgcaggtccacgaacagcctgccgtcggggaagagttcggcggtccggtggccgacgtgcacggcgagggcggtcttgcccatccccgagcgtccggagatcaccccgatcggcggagcggtcctggtggtgttgttgactccgtggagcagcgaggtggcccaggcgatctgctccgtccgtcccacgaagtcagccacgtcggggggcagatgggatggggcgggggcgggccggccggtcggctcggggccgaacctggtgggggcggcgatccggtgcgtgctgtcctgggcgtacgggattcggggaggggccgaggaggttgcggccggtcctgccgcgacggccttggccttccggccggcgccgacgccggtcccgaggccggtgcggacgccggtcccgaggccggtgccggtgccggtgccggttcccagccgctcgctgtcgttggtcagcacagcctggtgcagggcgcgcagctcgggcccggcgtcgatgcccagttcgcgacggaggacctcacgtccctcctggtacgtgcgcagtgcgtcagagatccggccggtacggaacagcgcggtcatcaactgtccgcgcggtcgctcccggagcggatgggcggcgacatgcgcgaggaggggtgcgatcgtctcgtcctcgcgtccgagcgccaaacgcagaccgaaggactcctcctgggccaccagccgcagctccgccagccgggcggcctcgatccgcgcgaaggactggccgagcccttcgagtgcctcctgcccgcgccacagactcaaggcgtcggacaggatgtcggcggcctcgcccggacggtcgcgcgcggccgaactccggcccagcgcgaggagttcctcgaaacggcgggcgtcgacctgtgagggactgaagtcggcgacatacccaggcggccgggtccggatcaccggagcctcgctgacccgtgcgagcgctcggcgcacggcggagacatgagtggcgaccagcgcggtggcggtggcgggcacctgctcgtcccagacgaaatccaccagtcgctcggtggagagcacttcgccgagatggacggtcaacgcggcaagcacggcaaggggtctggccccgccgagcggcgcccgccggttcccctgccacacctccaccggaccgagcagacgcacttcgaacatcgttccccgatcgccgcatcgtccgtcccgcggatgcaggacaacgatatcggcgaacgccgacaggacatgccgaactccggaccgccctgtccggttctagacggtccggcccaccgggccgacccctgctcaaagcctggcgtccgggacatgttccgcagtcgaccgcactccttctccggcgtcacttggctgatttcggcgacacgggcggcgccgctcatggggaagacgacaggcgcgagcccgtttgtatgaccgcggggacagacccgtcgtatgaccgcgggtgcgaagaagattcccgcgtacggcgagtcatacggaggcacggctcgaggcgtcaacggcccgacagcatcacgccggaccggttgaagcccagggggtatctcgatgaagcgcaccgacgcccggcacgggagggccgcaagcccggctgccgcccgtgacacagccgccccgcggaggcgatcgaggccgggtcggagcggtgtctctgtgctcgccgcgatgtgcgcggtcgcctccctcgccctgaccggctgcacacgggacaccgaccggccccaccccacctccccggtcgcgaaagccgaacgcacccggcagagcccggaactcacctacgccgaggacctgcggatctcggacgccgaacagcacttggtcaagcagtgcatggcgaggcacggttaccgcttctgggaggagcggacgctgaccctggaggagagccggccggtcggctacgtccaggacgacgtccgctgggcccgcacacacgggtacggcagccggatcatggcgaaggaggaccgcgcccggctccgcaaccccaatctcgcctaccgcgcgtcccttcccaccgcccggcagtcgacgtacgacaccgcgctggacggcggccggacagccacgctgctgaagatcgaggcacccggcggcggcacgatcaccaagcggtccggcggctgcacgggcgaggccgagaagaagctgtacggcgacccgaagacgtggttccgggccgactcgaccgtcagcaacctgcgccctctgtacgtgggcaagctgctgcgcgaccaggagttcagcggcgcggtgagggactggtcacgctgcatgcggcgcgccggccacccctaccgcgacccgaacgaggcacgtcaggcgatgcgcgagcacggcacgcgacagacccgggccgcggaggccaggacgttcgcggccgagacccggaccgcgaccgccgacgccggctgcgcccgcgccgcctcactcaagtccatcggcaaggaacgcgaggcccactacgtcggcgagttgtcggccgagtacggggacgccctcgacacctaccgccgtctgaagcgggccgctctcgcccacgccgaacagatcgtcccggcacgagcctgacctgccctgacctgccctgacctgccgggccgcgaaccaccgtcagcaccaccggcaccgtcagcaccaccgacaccggcaccggccctgccccggccgccgtgcccggccggcctgcccacccgtgatctccgtggctcactcgccacggctccctgtccgcgacgacgctcgcggctcactccccgtgacgaccgtcacggatccacagcgcctccgacgcgaggcagaacgggaatccatcatgcgcaagctgagcatcgccctcgccacgctgggcctcgcggccctcggcctcgccgtcccggccaccgcccacgcgagcgccggctgcgacgcgaagtggccgggccgtgacggcaacgtacgtgcctggaaggacgcggactgccagggcgaactcctcggcgtcacgcccggcagcgaccccaactggggtgacggcgccggccccttccaaggcagtgacgtcaatgtcgcgtcgtcggtcatgaacagcggttacgtcggcggcaaggacgtcgtcgccttctactacctgacgaactacaacgacacgagctacggctgcctcaagccgggcgaactgtacgtcgacaacctgggccgcaaccacttcaccaacggcgccaacatgaacgacaacatcatgtcccacacctgggtggccgcgagcgcctgcgccccgggctcattcatcggctgagcgtccccggttccggtcacgtgcccgtcggtgtcgcgccgacgggccatggcgtacctcttccttgcctcgtcggaccggcagaatgatcaaggcatgacatatttgatgaaatcagatcaagtcgacgaggtggtcgcgaaccgaggcctgtccttcgccttggagtcgcggccgtggatggcgacaggctgccgggtgacctccacgcaactgtcaccctgggaaccggggagctctgcgggacgcccacagtgcaggacgatgagcaccagggcgctttgaaggtgttcgtggaggacagccaccccctgacctcttcgttacgtggacgcccagtcccttgtccttggttaggctgcgcagccgcggtcgacgggcaatgccctggggcgggaggacccgtaacgctgcagacggcgcgcaactttttcaactgggctgtgcgatagggttacttcacgctgcgcgccttcccggagggtatgagagcggagttcagtggccagtccctcggccgtgactgacgagtggtttccactgcgtggcttcatgtggtgtgagagcggatgcccggtagggctgtccctgccattccaagctcactgccaaggagtggtcacgtatgaaccctgtcgagtacaagcccgcgcgtcgcatctggtttcgtaagatcctgatcgacgtcgctgctggcattgtcaccaaccttgtgttggcggcgctggtggcggtagtgcgcctgctcttctgagacgggcaagtggcgggcccggtgagcccgccactctcctctgcttcgaaggttcccgccctctcagaacagtgttttctgacccggctgccccttgtctcgccgattgcgtgaacggttccgccctccgcgccgcgggcggggaagatgcggtacgcgtgcctcagggggtaggttttcccaggtggggcgcaggccgtgaatctggacgttgcccaccagatccttgaggtagacgcgcgtctcctcgtccgtggagtagagcacggtcgcgcggctggcacgggtcatcagcacgtggtaggcatggcggacgagccgcgcgaagcccccatcgtcgacgctgctcgcccgcaccttcggatcaaacgaccccggcaccgctacgcgcttgacgcccgcctccaggtccttgcgctccttgccgcgccgaaatacccacttgccgtcacggcgcaccatgtcgtcacccatgatcacgccgcaccagtcccattcaagtccctgcgcggtgtacacgcagccgatctgttcgaggccgtcctggtgcaccgaccagatcttcgaaggcggagcaccgttctcgcagaagctctcactgtcagcgttccacggacggtgccagtcgccgatacggacgtcagcctcgagccgcttctccttgcccaggggcttggtccaaggccagcagtaacccgcaaccatacgcgctgaggcgccggcgagggcttccgagcggatgacctgctcgagttcctcggggctgtctgccacctcgatatgcatcagcccgtccggcgtccactgttccgctacgtcgtccgtcacaccgagtacggctcgcacccatcggatgtaggcatcgctgcctccgcaccggaactgctcgcggagcctgtagcggaccagttcggcgtcgtgccgcttggctgcattctcgatcagctcgacgttgccgacttcgttcggccgcacggactggctctcgtccaggaagaacacggtcagacgggacgcttcgagcagttcatccacctggggctttgtgccttgctgctcgggccgccagaagcggctggtcgagcggtcccgcagacgatgcgcctcatcacagagcaatacatccaaagggggctcgggtggagtcacgaaactactgaagtaggtgaagctctccctgaactcccggtctccgtagccgacatgctcctggatcgcgccgttgaaggcccggctgccgctggcgtacttgactgttcgcccattggcttcgagttccgccttgacctgcaaaccgatggcgctcttgcccgtaccggcaccacccgtcaccaggaagacgacccgtctctcgtccggcatgagagccggctgattcgggtctccgaggacaagggaagtcgtgccaaggatctggtcggcgacctcctgctggcgcccacgcagggtgaacactgtgtcctctccacgcgacctgatcatggcgtcgagcagtggcgtgttccgcaactgcatgctgcggagcagcgtctcggccgcggaggcgccgccgtcctcggcgaagtgcttgcgcaggtccgacatcagccgtccgcggccgtcgttcgtgtacatccgggcgtaagcgccggtaggcgcatcgaggtccatcaacggcttcacggacgcgtccgtcgcgttgtgcaggtacgcgaagcctccacactcgaagtcgagtccgctcagcggccctctggcaccggtgaaggcgtcgaagtactcccgcaactgcaccgccggatgcttcttctcgcccatccccggtacatgcaccaactctgctgtggccgcttccaccctggtcaccatcgaccagcgcttcagctcgacaagctgcaccgagaggccgcgcgtgtacggatgatggccgatcaagacgacgtcgatgagacggggagcacccgggcggtcggactcgtcgaccgtcgccgcacactccacgatcatttccacatttccccggttggccgccaccagatccttggcgagatcgaccaggctctccgcccaggcggaacgctcggagagcgaggcatccgatccgcggaagtgtttccacctggcggccaggtggggcaccatgcggcgccgtgagttcagggcgagcagatcctgcgccgataacttcagcaggagcatggacacgaggtgttcccccagggcacgagtgactcgtgcgggtgggggcatgtccatgtggggaagcccgtcgggccgcaaccggtacgggtgatcctagggaaccgctgcagactccgaggacgggaaccggctgtcggcttgatcgacgagcatcgtggccggatcgagttgtcagtcaggtgcgcttgtatgggcgcatgactgttcacgatcttgccgcggccctcccccgtatccccgacctgcggagcctgtgccggtcgatcgccgtggcggaggcggttctgaagcccggcgcgtaccggtaccactccttcgacgcaaactggtcggagacggaagaggtcttctccacgcggaatggcagcggggacgagttcgacatcgtcttctccccggctggtgcgtacatccgtggcttcgaccacgagtcgcccatgagcccctacgccgacgacgctgtctggccgggcgtactcgattcggtgccggagacctttcgggcctacgtcgaagatccacgttcgtcgacgacggcatgcccatggtgaccttctgcctgtggcgcgaaacggacgacgacacctggcacacgggtcgaatggactttccgaccgatgattcggaccccgacggttccgggtggatgctcggaccccttgtcgatccgcgcccggagaccttccagacattcgccgaggactactacgagaggcctgtcgatctggacgccgtgcgtcacatattcgaggagaggccgctgacgcaggacgtagtggcgcgtctgaatccggttgtctccttctcgggaatcaagaaggacgccgcggacatgggctatccggtatgaccgtattgggggggcagctccggtcatggcgctcgtccgcccacgatcagactgcgaccacctcgcgttgcacccccaccagttcgcgcaacttcgcccgcgtctcgggatccgtggagtacaccaccgtgccgaccatgccccgcgtcagcagcaccttgtaggtgttgcggatcaggcgatcgacgtccgaatccagagtggacttcttgaagaccggatccttggaggcggtacggtcggtgacccaggtgtcgccacgccagatcaggtccgggccgatgatgacgccggaccagtcgtactcgaagccctgtgccgtgtagacgcagcccacctggccgaagccggccgggtcggtcgcccacagggcggacggcggtgcgccggagatggcgcgctcgccccggaggttccaggggcgcgcccagtcgccgatgacgacgtccgccgggagcgggtcgcccggcttgggctccttcgaccaggtccagcagtatcccgcggacattcgggcgccgtatccctgccctcggcggttctggagaaacgattccatctcctccgggctttcggcgaccaggagttgcatccgatcatcggggtcccaggcgacagggccacccggctcgaggccgaggaggcgaacgacccagcgcaggtaggcatcgctgccaccgcagcggaactggctttcgagcggtacgacatgacactcaaagcccttcttcgcggcggccgccttgatctcggccactgtgcccatctcgccggggcgcaccacttggtgttcgtcgaggaggaacacaggcacccgggcgacgtcgatcaactcctcaatctgcggccgaccgctgcgatgggctgcaggggtgtagcgattggcggaggtctcgcggatgcggtgcgcctcgtcacagatcaggacgtcgagggtgttcttctctgtcgtcatgaagctgttgaagtacttgaagaggtcctgcacttcgcgcttgcgggcgcccgcgaccttacgcatggttttagtgaacgactgagagccggtggcatgtagagccggaacgccctgtcggtacagctcaccgagcaacgaaagcgcgatgacactcttgcccgttccgggacctccggtgacgatcaagacttccttgcgatcggactgcttcgccttgcgtacggcgttgagcactgtgcggtacgccacctgctgctcatccaggaggatgaactgttctcggtcttgcacctcctgagccgcgacggacatcagttgcttggaggggaccgtcttaccggcgaggagttcgtctgctgctcgggcgccagggtgcttgtcgctcagcttggaacggaggtggtccaggaattcccctcggcgctcggcagtgaacaattgcccctggtcgtcaagttcgatctctcgtagcccgctggccccgaactctgtggcattgtgcatgtaggccaccccgctgacgcgttgagggtgctcggcgaccgccccgttgaagttgacgaggtactcgcagtagcggcgtacctgctcgatgggattgaggaccgggtgtgcgtaggcgtccacatgacaaaggaccgggtcgtcctcatcaggcgcggcctggctccactgtttcagctctaccacgacgtacgccggttctcccgtggctgggtgcagcccggcaagcacggcgtcggcgcgcttgctgttcaacggcagcgcgtactcgatcatgacctctacgtcgcccaggctcgcttcgttcagtgccgccgtcagagcgggaatgctgcgttcccaggaacggacctcggaagggccggggcggtagccatgcatgcggacgaactgttcggtgagatgcaggaagagcgagccgtcgagcgccatgacagcgaccgttgcggcggacgcgcggaacagcaaggaattcccccaggcagcacgaaatgactcgtgcgggtgggggcatgtccttcgaaactccaccggcgtggagcggaagcccgtcgggccgcgatgacgatgtgatcaagggtacctgggcggcgagaggacttaggagcctctgggcagaccgtcagcctgctttggcgccagcctttcaggccgtgggccatcaacagggaatctcacacatgggctgccacaagcgcgggcagtgatcacgattccatcggaggccactccccccactgcctaggcggccgccccgtccctgtcagcgagcacttgcgtcaaacaggtacgcctgcccctatctctatggtcccgccaacgtccgcccgccgctgccgacggctgtgcatacccacccagaaaacagaaaaacccctggtcaacaggggtttttaactggtgtccgaggggggacttgaacccccacgcccgataaagggcactagcacctcaagctagcgcgtctgccattccgccacccggactaggtgtctgccgcctggccggaggtgttccccgcggcgacatggacaacaataccaaggtttcggagtgcctttcacctgcatatccgcgccccgacggcgggtgcacgaaggtcgtggagggcgcctacagactcactatgggaggccgaacggctacggcgggtccgcccgtgtatggcggccaagggcgctgtccacgctgcggaagcactggcgacacgttttgggttcgctccgaccgccgccctggtgctggtcctactcgtgtgggcggcggcaactcgagcctgtggctgatgcgggtcgtcgggcctgtcgccgatctgatcagggcggagtccatccggtcatcacaggcatgcctctcggcacctcccctacgtcaacgtcgcacgtttggtccacatggcccggcagcacggcgtcgtcctgcggatcatccacggatcggtgacttcgtggttcccaagaccccggtgtttgctgtgcacagcggccccgtcaccaatgggctgcggccccctgcccggccggcaaccgctcggcgcctcgctccaccgtgaccgacgggggacggtacggctggtgccgtgccgagcttgagcgagctggtggatctagggttcgccgagatctacgggtgtgcgggcagcagcccccagcagcaagtagcgcccaggtgaggcagcggctgctggccgggctcgacgatccgccgctcctggcacccgaggagcggcggctgctgctggctcagtccgtggaacggagtttcccggaggcggcggaccgcgccttcgctctgcgaccggaccggcaaggcatcggttgggcggcccgatccaccgccgatgggcagacaagatcatcgctccggtgaccggtcgggcggcaccgcggacgccggcgccgcccgacccggcctcacggcatgaggtggtactccgggaagttgccgggcagccgctcccccgccggcccctgtgtcaccgcacgtaccagcagctcgccgcccacgaacgcgccgcgccacgacgcgccgaagccgccgaacagctcgtcgcggtcgccgcgtgagcgaggcttgccgtggccgaccttgaacgcgcggatctgtggggacagacggtcgtacgtcgccctgtcgtcggtcgacaacgtggcgaccagcgcgccgttggacgcgttcatggcggccagcagctctgcctccgtatcgaccaggacgatggtgtcgaccgggccgaacggttccgcgtggtgcagcggcgaggacgggggcgggttcaggagcgtcaccggctggacgtacgccgacgtgtcctggccgggcaggaagcgggcgtcggtcagcctggcgcggtgcagcgggacggcgccgcggtcgatggcctcggtgacctggtcgttcagctccttcgccttggccgcgttgatcaccgggccgaagtccagctccgggtacgggtcctcgcgccgctccaccgccagcgggtggccgacccgcagggtgcggacggccgggaggtacgcggccaggaactcgtcgaacagggtgcgctggacgacgaagcgcgggtaggcggtgcagcgctgtttgccgtagtcgaagagcttggggatgacggccgtcagtgcgtcccagtcggtgtagttccagacgccccaggtgttcagtccctcctgttcgagtatgtgtcgcttgcccaggtcggcgacgtccgtggccaccgcggcgcccgtgtcgcggccgccgacgaaggagacacagccgatctcgggggcgcggaccagggcctccgagagctcgcctccgctgccgctgacgagggtgacgggaatcccttcgcgggcggcgagcgcgccggccagggtcagacaggcgacgccgccgtcggtcggggtcttggcgatgaccgcgttgcctgccagtgcctgtaccagcatcgcgtgaacgagcacgctcatcgggtagttccagctcgcgatgttggagaccggtccgtccagcggcgcccggtccgcgaccatgggttcgattccgtcgacgtaccagcggacgccgtcgatcgcccggtccacgtccgcctgcgcgagccgccacggcttgccgatctcccagacgaggaggagggcgagcagctcgcggtgttcggtcagcgcgtcgagggtcgcggcgacgcgcgcccggcgttcgtccagggggacgtggcgccaggcgcggtgctggtcgagcgaggcgcgtacggcctgcccggcgatgtcaccgtccaggcgcggcggtcccgcgatcgggctgccgtccacgggactggtcgcgggcagcgcccggccgtccgtctgccaggcggcgccccagaggttgaggacccggtcgtcccggaacgcctcgggtgcgaccgccagacagcgccgccaggcgtcggaccaggacgtgccggatttgagggtgagggtgggtgccattcgtttgctccgctctcggtgcacagtcgggggcggtaggtgcatggctcgtccgcgcacacggtggtgcgccgacgtcgtacggaggaaggtagtgacacggcatgacgcgcgacagttacctcgcttcaactatgagtgacgtcacgctccgcttccagtcgggccagcaccagccgtgccgtcgcggtcggcgtgccgcccacctgcacgcccgcgccctccagggcctccttcttcgcccgcgcggtgccggacgaaccggacacgatcgcccccgcgtgccccatggtcctgccctcgggggcggtgaatccggcgatgtagccgacgacgggcttggtgacgtggtcgcggacgtacgcggccgcccgttcctccgcgtcgccgccgatctcgccgatcaggacgatgagttcggtgtcggggtccgcctcgaaggcggccaggcagtcgatgtggctcgtgccgacgaccgggtccccgccgatgccgacgcacgtcgagaagccgatgtcgcgcagctcgtacatgagctggtaggtgagggtgccggacttggagacgaggccgatgcggccgggcttggtgatgtcggcggggatgatgcccgcgttggactggccgggggagatcaggccggggcagttggggccgatgatccgggtgcccttggcggcggcgtacgcgtggaaggcgaccgcgtcgtggaccgggatgccctcggtgatgacgacggtgagcgcgattccggcgtcggcggcctcgacgacggccgccttggcgaaggcaggcggtacgaagacgacggtgacgtcggcgccggtcgcctcccttccctcgcgcaccgagccgaacacggggacggtccgctcgtcgaagtcgacggcacggcccgccttgcgcgggttgaccccgccgacgacgtccgtgcccgccgcgagcatgcggcgggtgtgcttcatgccctcgccgccggtcatgccctggacgaggaccttgctctccttggtgaggtagatggccatgtcgggctccttcagccggcgtcggcgagttgggcggcgcggcgcgcggcgccgtccatggtggtgacctgctggaccagggggtgccggcggccgtcgaggatcgcccgcccccgtgccgcgttgttcccgtccaggcggaccacgagcggcttggtcaaccggacggtgtccagggcctgcacgatcccgtcggcgaccgcgtcgcaggcggtgatcccgccgaagacgttgacgaagacggacttcacggccgggtcggagaggatgacggacaggccgtcggccatgatctgggcggaggcgccgccgccgatgtcgaggaagttggcggggcgggccccgcagcccgcgaccacgtcgagcgtcgacatgacgaggcccgctccgttgccgatgatgccgacctcgccgtccagcttcacgtagttgagccccttggccgctgccgccgcctccagctgatcgccgtgctccgcggcttcggcgccccaacgcgtctgccggaagcgggcgttgtcgtcgagcgtgaccttgccgtcgagggcgaggatctgcccctgcgccgtacgcacgagcgggttcacctcgaccagtacggcgtcctcgcggagcagtacctcccagagccggacgagtacgtcgacggtcgccgggggaagcccggccgcttccgcgatctcggccgccttcgcggaggtgacaccctcggccgggtcgacggggacacgcgccacggcttccgggcgggtggcggccacctcctcgatctccatgccgccttccgcggaggcgatggcgaggaagcggccggccgcgcggtcgagtacgtaggagacgtagaactctgcctcgatgtcgacgggttcggccagcatcaccttgccgaccgtgtgtcccttgatgtccatgccgaggatctggcgcgccgtgagttcggcggcggcggggtccgcggcgagcttcacaccacccgccttgccgcggccaccggtcttgacctgcgccttcactacgacgcggccgccgagcctgcgggcgatgacgcgcgcctcctgggacgagtcggtgacctcggccctcggcaccaagatgccgtggtccgcgaagagttcccttgcctggtgttcgtacaggtccatctcggctcctgtctgccgtgtctgtccgggagcgatccccgggcccccgaaaagtgccgcacgccccctggacaccacccaccggatgcgggataacaagcttcatacagtattcgtcgactgtatgcaatgtaccgcgagagcgttccaaccccctacgaagggacaggacttcgccatgcccgacggcagcagcgacaacaactcggacctcatctccggtgggcacctggtcgccaaggcactcaaagcggagggggtggaggtcatctacaccctgtgcggcggccacatcatcgacatctacgacggctgcgtggacgagggcatcaaggtcgtcgacgtgcgtcacgagcaggtcgccgcgcacgccgccgacggctacgcgcgcatcaccggcaagcccggctgcgcggtcgtcacggcgggtcccggcaccaccgacgccgtgaccggtgtcgccaacgccttccgcgcggagtccccgatgctgctgatcggcggccaaggggcgcacacacagcacaagatggggtcgctccaggacctcccgcacgtcgacatgatgacgccgatcaccaagttcgcggcgaccgtgccggacacggcgcgcgccgccgacatggtgtcgatggcgttccgcgagtgctaccacggcgcaccgggcccctccttcctggagatcccgcgcgatgtcctcgacgccagggtgccggtgagcaaggcccggattcccgccgccggccagtaccgggcctcgacccgctcggccggcgatcccgaggcggtcgagcagctcgccgacctcctcgtgcacgcggagaaaccggcgatcctgctgggcagccaggtgtggacgacacgtgggaccgaggccgccgtcgacctcgtgcgcaccctcaacatcccggcgtacatgaacggcgccgggcgcggcacgctgccgcccggggacccgcaccactaccagctgtcgcgccggtacgcgttctccaacgccgacgtcatcgtcgtcgtcggtacgccgttcgacttccgcatgggctacggcaagcggctgtcgccggacgcgaccgtcgtgcagatcgacctcgactaccggaccgtcggcaagaaccgggacatcgacctcgggatcgtcggcgacgcggggctgatcctgaagtcggtcaccgaggcggcctccgggcgcctcaacggaggcgcgtcgaagcgcaaggagtggctggacgaactgcgcgccgccgagcagacggccctcgacaagcggctgcccagcctgaggtccgacgcctcacccatccacccgtaccggctggtcagcgagatcaacgacttcctcaccgaggactccgtctacatcggcgacggcggtgacatcgtcaccttctccgggcaggtcgtgcagcccaagtcgcccggacactggatggacccgggtccgctgggcacactcggcgtcggcatcccgttcgtgctcgcggccaagcaggcgcggcccgacaaggaagtggtggccctcttcggcgacggcgcgttctccctcaccggctgggacttcgagaccctcgtccgctacgacctccccttcgtcggcatcgtcggcaacaactcctcgatgaaccagatccgctacggccaggcccagaagtacggcctggcccgcgagcgggtcggcaacaccctcggcgacgtccactacgacaagttcgcccagatgctgggcggttacggcgaggaggtccgcgaccccgccgacatcggcccggcgctgcggcgcgcccgcgagtcgggtaagccgtcgctgatcaacgtctgggtcgacccggacgcgtacgcccccggaaccatgaaccagacgatgtacaagtgaggtgagccgaccatgaccaaggctctcgaaggcatccgcgtcctcgacatgacgcacgtccagtccgggccctccgcgacccagctgctcgcctggctcggcgcggacgtggtcaaactggaggcgccgaccggtgacatcacgcgggggcagctgcgcgacctcccggacgtcgactccctctatttcacgatgctcaactgcaacaagcggagcatcaccctcaacaccaagaccgagcgcggcaaggagatcctcaccgagctgatccggcgctccgacgtcatggtcgagaacttcggaccgggcgcggtcgaccgtatgggcttcacctgggaccgcattcgggacatcaatccgcggatcgtctatgcctccatcaaggggttcggcgacgggccgtacaccgacttcaaggcgtacgaggtcgtcgcgcaggccatgggcgggtcgatgtcgaccaccggcttcgaggacgggccgccgctggcgacgggggcccagatcggggactcgggcacgggcatccacgccgtggcggggattctcgcggcgctgtaccagcgggagaacaccgggcgcggtcagcgggtcaacgtggccatgcagcatgctgtgctcaacctctgccgggtgaagctgcgcgatcagcagcgcctggcccatggcccgctcgctgaatatcccaacgacgacttcggcgacgaggttccccggtccgggaacgcgtccggcggcggccagcccggctgggcggtcaagtgcgcgccgggcggccccaacgactacgtgtacgtcatcgtgcagcccgtcggctggaagccgctcagcgagctcatcggccggcccgagctggcggacgaccccgagtgggcgacgccggaggcgcggctgccccagctcaccaagatgttccagctcatcgaggaatggtcggccacgctccccaagtgggaggtgctggagaagctcaacgcccacaacatcccgtgcggccccatcctgtccaccaaggagatcgtcgaggacgcgtcgctggtcgccaacgagatggtggtgacggtgccgcatccggagcgcggcgagttcgtgaccgtgggcagcccgctgaagctctccgactcccccgtggacgtgaccagctcgcccctgctcggcgagcacaacgcagaggtgtacgtcggcgaactcggcctcggggacgaggagctgcgcctgctcaagtcgaacggagtgatctgacgtgatggccgaagaccgggcgctgagggtgcggacgctcctcgacaccgtgcgggccgagggacggaccgcgctgacggcgcccgagggcaaggtgatcgccgacgcgtacgggatcgccgtgcccggcgaggaactggcgacggacgtcgacgaagcggtcgcgtacgcggcgcgcttcggcggccccgtcgtgatgaagatcgtctccccggacatcctgcacaagaccgacgcgggcggcgtcatcgtcggtgtggagggcgcggcggacgtacgcgccgccttctgccggatcgtcgagaacgcgcgggcgtacaacgagcgggcccgcatcgagggcgtacaggttcaggaactcctcccgcggggacaggaagtcatcgtcggcgcggtcaccgatccgacgttcgggaaagtggtggccttcgggctcggcggcgtacttgtagaggtcttcaaggacgtcacgttccggctggcgcccgtggacgccgacgaggccctgtcgatgctggactcgatccgctcgacggagatcctgcgcggggtgcgtggggccgccgcggtggaccggtgggcgatcgccgagcagatccgccgggtgtcccgactcgtcacggacttcccggagatcgcggaggtggacctcaacccggtggtcgccaccccggagggcgcggtcgcggcggacatccgggtgatcctcgcggagtcgcagccgaagccccgacgcacgtacacgcgcgaggagatcctcacctccatgcgccggctgatgcagccctcctccgtcgccgtgatcggtgcctccaacgagcacgggaagatcggcaattcggtgatgcgcaacctcatcgacggcggcttctccggagagatccatccggtgaaccccaaggccgacgacatcgtgggccgcaaggcgtacaagagtgtcacggacattcccggtgaggtggatgtggcgctcttcgcgattcccgccacgttcgtggccgcggccctggaggaggtgggacgcaaggggatccccaacgccgtactgatcccctccgggttcgcggagaccggcgagcacgaactccaggacgaggtcgtggcgatcgccgagcggcacggcgtccggctgctcgggccgaacatctacggctactactcgacgtggcacgacctgtgcgccacgttctgcacgccgtacgacgtcaagggcggcgtcgccctcacctcgcagtccggtggcatagggatggccatcctgggcttcgcgcgcactacgaagacgggtgtctcggcgatcgtcgggctcggcaacaagtcggacctcgacgaggacgacctgctcacctggttcggcgaggacccgcacaccgagtgcatcgcgatgcacctggaggacctcaaggacggccgcgccttcgtggcggcggcccgggcgacggtccccaggaagccggtcgtggtcctgaaggcgggtcgcacggcggcaggcgccaaggccgcgggatcgcacacgggcgcgctcgcgggcgacgacgccgtgtacgacgacatcctgaagcaggccggggtcatcagggcgcccgggctgaacgacatgctggagtacgcgcgcgcgttgccggtgcttcccactccccagggcgacaacgtcgtgatcatcaccggggccggcggcagcggcgtgctgctgtccgacgcggtgaccgacaacgggctgtccctgatggagatcccgccggacctggacgcgtccttcaggacgttcatcccgcccttcggagccgcgggcaacccggtcgacatcaccggcggtgagccgccgtcgacgtacgaggcgaccatccggctgggtctcgaggacccgcgcgtccacgccctggtcctcggctactggcacaccatcgtcacccctcccatggtgttcgccgagctcaccgcgcgcgtggtggccgagttccgggagcgcggcatcgagaagccggtggtggcgtcgctcgccggcgacgtcgaggtcgaggaggcctgccagtacctctacgagcgcggggtcgtggcgtacccgtacacgaccgagaagccggtggccgtactcggcgcgaagtatcgctgggcgcgggcggcggggctgttggggggcggttcatgaggtgaccgagcgcggggcggccgacggtgcgcgtcggccgccccgggacccgtgcgcacacgaaaggcattggacagggggcgctggccagaactttcgacgcaaggggcaatcgcgatatgacaaccaccgacctatcgacgtccgtcccctacagggaggtgacggaccgcaacggccgcgtgtaccggatcggcgagaccgataccgacctcatgggccggccacgcacctggatggtcatcctgccctgggtgggcatgatgggcatcagctccgccgagtacgcgttcacgtcggcggaggacaccctccacgaggctcatctgtggagcagcggacacatcttctggctgatgggcgtctgggtgttcttccaggcggccgtggccttccccgccggacagctgcgggagagcggcaggctgcccgcccgcacggcgatgatgatcggcgcgctcggcaccctgctgggctatctggcgctggctttcgcgccgaacgtggtcgtcgcctacgtcggcttcggcatgtgcagtggcatcggcgccggcctggtctacgcgacctgcatcaacatggtcggcaagtggtatccggagcgcaagggcggcaagacgggcttcgtgaacggcggtttcgcctacgggtccgtgcccttcgtcttcatcttcacgtcggtgctggacctgagcaactacaaggtcgtgctcagctgcgtgggcgtcgggctgtgcctggtggtggcgtcggccggctggttcttcaaggatccgccgaagagctggtggcccccgcacgtcgacccgctgacggtgaccgacgacccgaggatccgccgggcgctggcgaagaacccgccggcggtcaagcagtacacccccaaggaggccgctcgtacgcccgtgctctggatgatgtggttctgtctgctctgcacggccggcatcaacatcttcggcatcgccttccaggtgccgttcggcaaggacatgggcttcgcgggcgggatcgtggccacggcgatgtccctgaaggccatcgtcaacggcaccgggcgcggcgtgatcgggtggatatccgatcgctacgggcgccgcaacacgctggtcgtcgtgtgtctcgtgctgggttccgcccagttcggcgtcctggtgtcgggccagatgggcagcatgccgttcttcctgttctgctccatggtctccggattcggcggtggtgcgatcttcccgctgttcgcggcgatgaccgcggactacttcggcgagaacaacaacgccagcaactacggaatggtctacagctccaagctcatctcgggcctggtgggatccggtctgggcgcggtcgtcgtcggtgcgtgggactacgacggcgcgttcgtcctggcgggctccgtcgggctggcctcggcggtcctggcgctgttcctgcgggcgcccggacggcccagggcccagcacatcctccccaacccgcagccgctcggcgaggagatggcgtgacatgacggcggaccccatcgcggcgaggagcgcgtcggcagaccccggcgccccgaaccgctcgtaccgggaagtgaccgactcgcgcggccgcgtctaccgcgtgggcgagacggaccgcgacatcctcggccactcacgaaaattcatggtgtacctgccatgggcagccatgatggccatcagcgtcttcgaatacgcgtacggctcggccgaggacaccctgtcccacgcccacggctggacgcagagcaacacgttctggatcctgagcgtctgggtcttcttccaggccggtatcgccttccccgcgggctggctgcgcgagaagggcgtcctgaccgcctgcacggccatgcacctcggcgcgggcatgtgcctggtcggattcctcgccctgtcacacctgagcaacgtgctcctggcgattctgggattcggtgtcgtcggcggcatcggttccggcctggtgtacgcgacctgcatcaacatggtcggcaagtggttccccgagcgccgcggtgcgaggaccgggttcgtcaacggcgggttcgcgtacgggtcgcttcctttcatcttcatcttcaactacgcgttcgacacggcgaactaccaccgggtcctggacctcatcggctgctacgtgatgatcgtggtcctgtccagcgcgttcttcttcaaggacccgccgaagaactggtggcccgcggacatcgatccgctgacctgctcgggcaacggcaagagcgccgcgagtctcgcgaagaacccgcccgcggtgaagcagtacacgcccaaggaggccatcaggaccggtgtgctcccgttgatgtggatcactctcgtcatgacggcaggcgtatcgatcttcgggatctccttccaggtcgacttcgccaaggaggtcggcttcgggccactggtggccgcctcttcgatgggcatcatggccgtcatcaacggcatcggccgcgcggtggtgggctggctgtccgacatcttgggccgcaagctcaccctggtgttcgtgatcgtcgtcctgggtctcgcccagttcggcgtgatctgggccggcgacgtcaagagcgagtggctgttcctgttcttcgccttcctctccggattcggcggcggcgcgttctacccgatgttcgcggcgctgaccccggactacttcggcgagaactacaacgccaccaactacggcctggtgtacagcggcaagctgatcagcggtctgttcggcggcggactcggctccatggtggtcgcggcctggggctacaacggcgcgtacgcgctggccggggcgatctccatggtggcggcggcgatcgcgctgctgctgaagcagccggggcggaacacggacaggagcctgactccggagccgcagccggcgggctgagcgcggcgacgttcgaggggccctgtccgggaggtggctcgctgacagggcccctcaagcgtggggtccggtgcggcgcagggcgcggttgatgtcgaagcctccttggcgtacgtcggtggggcgggtcggcgcaggacggcggacggggtccggtgtccctcgcccgccgtcgctcagcggcccggcgccccggcgggcgcgggaagttcacaagggtgccgcttcgtgtcagtcgttgccgccgaacgccgcgtcgaaggaggccgacggtggctcgaagtcgtacgccttcaggcgggtcagcgcctcgggggcgccctggagccggtccatgccggcgtcctcccactcgacggagacgggcccgcggtagtcgatggagcccagcatgcggaagacgtcctcccagggaacgtcgccgtggccggccgagacgaagtcccagccccggcgcgggtcgccccagggcagatgcgagccgaggcggccgttgcgtccgtcgagccgcttgcgggcctctttgcagtcgacgtggtagacgcggtcgcggaagtcgtacaggaagccgacggggtcgaggtcctgccacacgaaatggctcgggtcgaagttcagcccgaaagcgggccgatggtcaacggccgccagtgcgcgctgggttgtccagtagtcgtacgcgatctcgccggggtggacctcgtgcgcgaaccgcacgccctcggcgtcgaagacgtccaggatcgggttccagcgctcggcgaagtcctcgtagccgcggtcgatcatcgactcggggacgggcgggaacatggcgaccaggtgccagatggcggagccggtgaagccgatgaccgtgtcgacgccgaaggccgccgcggcgcgcgcggtgtccttgatctcggccgcggcccgctgccgtaccccttcggccgcgccgtcgccccagatccgcgcgggcaggatcgcccggtggcgctcgtcgatgagggcgtcgcagaccgcctgaccgaccaggtggttggagatcgcccagcacgtgaggccgtacttgtcgagaagcgcgtgcctggactcgaggtacgtcgggtcggcgagggccctgtcgacctcgaagtggtcgccccaacaggcgagttcgagtccgtcgtagccgaagtcgcgggcgaggcggcagacctcttcgagcgggaggtcggcccactggccggtgaagagtgtgaagtcgcgcggcattcccgggcctcctcagaccactacgggtgtgtagacggagttcttggcggcgctctcctccaccgccgccagcacgcgctgcacttgcagcccgtcggcgaaggacggctcggggcggtggttcgccgcgatggcatggaccaggtcgcgggcctggtggacgaaggtgtgctcgtagccgaggccgtggcccggcggccaccaggcttccaggtaggggtggtcgggctcggtgaccaggatgcggcggaagccggcgtgcgcgaggggttcggtgtggtcgtggtacgcgagctcgttgagccgctccaggtcgaaggccaacgagccgcgctcgccgttgagttcgatgcgcagggagttcttgcggccggtcgcgaaccgggacgcctcgaaggtggcgagggcgccggaggcgaagcgggcggtgaagagagcggcgtcgtcgacggtgacggtgccgagaccgcccgcggagaccgcggcgagcccgccggtcgtgccgccgggcagcggacgctcccgtacgaaggtctcggtgagcgcggagactccggccaggggctcgcccgcgaggtactgggccaggtcgacgatgtgggcgcccaggtcgccgagcgcccccgaaccggccacttccctgcgcagtcgccaggtgagcggaaactcggggtcgaccagccagtcctgaaggtacgtcacccgcacgtgccgcagggtgcccagccggccttcgcggaccatccgccgggccagcgaggtggcgggcagccgacggtagttgaagccgaccatggtcaaccggccctgccgataagcctgttcgcccgcggccgccatggcctccgcttcctcgaccgtgttcgcgaggggtttctcgcacaggacgtgtttgcccgcggccagcgcggcgacggcgatctcggcatggctgtcacccggggtgcagatgtcgacgacgtcgacgtcgtcacgggcgatcagggcgcgccagtcggtctcggccgccgcccagccgtgccgctcggccatggcgcgcacggcctgtccgtcgcggccgcacacggcggcgagcaccgggcgggacggcaggtcgaagacgcggccgacggtgcgccagccctgggagtgggcggcgcccatgaaggcgtagccgaccatgccgataccgagcggcggcttcccggcgtccgcctcgtcgcgcgggtgcggctgtcccataccgttgtcctcctcttcgtcgtggcgcggtgggggtgcgagcaggggcggtcacctgaagccggtggacatgtactggccgacgttgtccttgtcgacgaccgccgagtagagggtcagggaggccgggatctcgaactcggcgaggccgccgacgcccttgccctggccgagcgcgcgggccaggtcgatggcggacgcggccatggtcggcgggtacagcacggtcgccttcaggacaccgtcgtccgccttgatggcctggaaggcggagagcgcgcccgcgccgccgaccatcaggaagtcgtcccgtccggcctgcttgatggcccgcagcgcgccgacgccctggtcgtcgtcgtggttccacagcgcgtcgaacctggactgggcctggaggagctgggccatcttcgactgtccggactcgacggtgaactcggctgcctgccgggcgaccttcctgatgttcgggtagttcttcagcgccgcgtcgaagccctgcgtgcgctgcttggtgagctccaggttgtccagcccggccagctcgacgacgcgcgcgttcggcttgtccttgagcttctcgccgatgtagcggccggcgctcagccccatgccgtagttgtcgccgccgatccagcagcggtacgcctgcggggagttgaagatacggtcgaggttgacgacgggtatgcccgcgcgcatcgccttgaggccgacctgggtgagtgccttgccgtcggcgggcaggacgaccaggacgtcgaccttcttgttgatcagcgtctcgatctggccgatctgcgcggcggtgtcgttggagccctcggtgatctccagcgtcacgtcgccgtacttcttcgcccggctcttcgcgttgtcgttgatcgcgttgagccagccgtggtcggcctgcggtccggcgaagccgatggtgacgtgcttgccgggtttgtcgtcggcggccgaccggtcgttcgcggccggcttctcggacgtggtgtcattgcttgtgcaacccacgaggagggcaccggcggatacggcggcggtcccgaagagcagtcctctgcggctcgtgacaggtgtcggctctggcatggcggtgaaccctttcctcaggtcgtgctcgcggtacggcgctggaccagcacggcggcgacgatgatcgcgcccttggcgatctgctggacgtcgctctgcaggttgttcagggcgaagatgtcggtgatcgtggtgaagatcagtacgccgaggaccgagccggtgatggtgccccggcctccgctgagcagggtgccgccgatgatcgcggccgcgatggcgtcgagctcgtacaggttgccgttggtgttctggcccgagccggacaggatgatcagcaggaaggcggcgatgccgcagcacagcccggagagcaggtagaggtacagccgctggcgtcgtacgtcgatgcccgcgagccgggccgcctccgcgttgccgccgacggcgaccgtgcgccgcccgaaggtggtgcggttcaggatcagccagccgatgaccgtcacgaccgcgaagaccaggacgagcggcgggatgccgagcagataggaatcgcgctcccccagcttcaggaccgtgtcgacggtgacgatctgtgtcctgccgtccgtgatctggagcgcgaggccgcgggccgaggccagcatggcgagcgtggcgatgaacggcaccagcccgccgtacgcgatcagcagtccgttcacgaggccgcagcccacgccgacgatcatcgcggtgaagaggatgccggcgaagccgtactcctgggtggcgacggtggtggcccatacggaggcgagggcgacgatcgcgccgacggacaggtcgatgccgccggaggtgatgacgaaggtcatgccgacggtgacgacgccgatcaccgaggcctgggtgaggacgagttggagattgcgggtgtcgaggaactcgtcgggtttggtgatgccgccgatgacgaccagggcggcgagcacaccgagcagcgagagcgtgcggacgtcggcgcgggcggcgagggagcgccatgcggggagttcactcaccggtgacgcctggccggtgccgcccctgggcggagatacgggctgcgtcatgacgccggggttccttccacggggcttccttccatgaccaggtcgaggacgcggtgttcgtcgagttcacgggcgggcgcccggtgtacgacgcggccctcgcgcagcaccagcacccggtcggcgaggccgagcacctcgggtacctcgctggacacgagcagcacggcgaggccctcgtcggcgaggcggcggatcaccgcgtacagctcggcgcgggcgccgacgtcgacgccgcgggtgggttcgtcgaggagcagcacccggcagccgcgcagcagccagcgcgccaggacggccttctgctggttgccgccggacagggtgcgcgcgggcgcggacggacggtcggggcgcagtgacagttcccgggtcgcggctcgcgcggcatcgcgttcggcgccgcggtcgatccaacctccgtgtgcgaagcgggacatggaggagagcgacacattgcgcgtgacggactccagcaggagcagggcctgcgtcttgcgctcctcgggggcgagcccgagtccggcgcggacggcggcgcgtacgctgccgggccgcagcgcccgtccggccaccgtgacctgccctgcggacggcttccgggccccgtagacggtctccaggatctcggaccgtcccgaacccaccagtccggccagtccgacgatctcgccggggcgcagttcgaggtcgaggggctcgaactcgccttccctggcgaggccctggaccttgagtagggggtcggaggtggctggggcaggggcgggcggccggtccgggaagacgtactccacgtcgcggccggtcatcagcgccacgatctcgcgcgtcggcgtggatttcgcgggcagcccgcccgccaccgcgcgcccgtccttcagtacggtcacccggtcgccgatccggcggatctcctcgaggcggtgcgagatgtggacgacggcgacgccgtccgcggtgaggtcgccgacgatgcggaagaggttgtcgacctcgtcgggatcgagggccgcggacggctcgtccatcacgatgaggcggacgtcgtgggagagcgcgcgcgccatggagacgatctgctgctgggctgccgacaggtcgccgacgaggcgcgacggtgcgatctccgggtggccgaggcgcttgaggagagccgctgtcgaggctcgcgcggccttccctcgtacgacgaagccggcggtcgtgggctcatggccgaggtggacgttctcggccaccgacaggccctccaccaggtctagttcctggtagatggtggcgatgccgaggcgcatggcggcgatcggggagcggagcgtgacgggtgcgccgcgccagcacagacggccgtcgtcgggctggtgggcgccggccaggaccttgatgagggtggactttccggcgccgttctggccgagcagacagtggacctcgccggcctgaacgtcgaggtcgacgccgtcgagggcccggacgccggggaacgacttggtgatgccggacatggtgagcagcggtggttctggtgccatgacggttccctttggcaggcgtgcgggccggtttcagggcgtgcgcttgcggagcaggcatgcagggcgtgcggcaggcattcaggcagggcggagcagggcgctgtgctggtcgtgcgcgcggtacggcgggtgcttacgcgggtgagaacaggtggtcgctgatcagccgggccgcgccgatgactccggcggtcgggcccaactcgcccagcacgatgggcagattgccggtcgcgagcggcagcgactgacggtagacctgggtgcggatcgcggcgagcagggtgtggccgaggccggtcaccccgccgccgatcaccaccagtccggggttgaagaaggagacgagtccggcgatgacctgaccggtgcggttgccgccctcgcggatcaggtcgagcgcggtggcgtccccggcggcagccgcggcggcgacgtcgacggcggtgagcgtgcccgccgccgccagccgggtggcgagctcttccgaaagcccctgctgggcggcttcggtggcgtcgcgggcgagcgccgcgccgctgaagtgggcctccaggcagccacggttgccgcacgcgcacgggcggccgtccggcaccgcctggatgtgcccgatgtcgcccgcgctgcccgtcaccccgcggtgcacctcgccgccgacgacgatgccgcagccgatgccggtgccgatcttgacgcagaggaagtcgcccacggagcgtgcgacgcccgcgtgctgctcccccatggccatgaggttcacatcgttgtcgaccatgacggggcagccgagatcctggctgagcgcctcgcgcaccgggaagccgtcccaccccggcatgatcggcggcgcgaccggtatgccttccgggaaccggaccggacccggcaccccgactccggcgccgtcgaagccctccgcgagccccgaagccctcaacttggctgccatggcgaggacttgctcgaagacggccaccgggccctcgcggacgtccatgggctggttgatgtgccccaggacctccagttcggcgttggtgacggcgacgtcgaccgaggtcgcgccgatgtcgacgccgaggaagcggagcgcgggcgcgagccggatgttgtgggagcggcggccgccccgggaggcggcgagtccgtcggccacgaccaggcccgtctccagcagccggtccacctcgacggccagcttcgaccgcgagagatcgatccggtcgcccagctgagcgcgggagttggggccgtcgtcacgcaacaggcgcagcagccgggcctggtgagcgttcgcgggtcgagccgtcatacgtctcacgagcccctccccgtctcaactggcctgcgtgcgccgggttccggccatcgcctggctcgctttcgaggggaacgtagcagtggctgccgggagtgggaagaagtctcacaggaattaccgacgactttcgccactgaaaggacaaagaccggctttcctcgtcgccctggtggtgccgtcggtggggatgccgggcgggggcccactgggcggcgtacgagccggcggccgcgcgcgtacgccgaggccgcgcgcgtacgccgaggctgcccgccccctccgggcgaccgcctgacgactccgcggccgccgcctggcgcccctcggtcaccgcctgactacgtcgtggccacgtcgggatccctcgcccggctacttctcgcgctcgtggtacgtcttgcgcgtgtgctcggtgtgggcgcgcatgacctccgtcgcgcgccgctcgtcccgcgccgagatcgcgtcgatcagatcgcggtgctcgatccaggactggcggccgcgctgccgggcgaccggcgtgtagtaccagcgcacccggcggtcgacctgcgcggccagctcggcgagcacggcgttgcccgcgagctccatgaccttcgtatggaaccgggcgttcatcgcgaccgctccgtccacgtcgtcgtcggccaccgcccgctcgccctgcgcgcacagctcttcgagggcggtgatgcccgccgtgcccgcgttggcggcggcgagccgggccgcctcggcctcgaggagcgtacggaccgtgaggagctggtcggcctcgtcctccgtcggttcgtgcacgaacgcgccctgggcgggccgcagatcgacccacccctcggtgttcagccgctggagcgcttcgcgcaccggctgccgggagactccgaggtgcccggcgagttcgctctcgacgagatgctggccgggctggagggcgcgggtggtgatgagttcgagcagcgcctcgtagacgcggtcgcgcagcggaccgggccgttcgagcttgggcaccgtcccctgcggcagtcctgcggacaacatggcggtcccctcctgggcagtggcggcagcagcacagcaccggaaagacagtatcgattgtctttcgtctacagtctacggcgcacaacagccagggcgagggggagttgggctcatcacaccgagccgtacgagcaggtcacgggcagctcacgggcagcggatgacctggcccgcgtacgacaggttcccgccgaagccgaagaggaggaccgggtcgccggtcgagatctccccgcgctccaccagcttggagaaggcgagcgggatgctcgcggccgacgtgttgccggactcgacgacatcgcgtgcgacgacggcgttcacggcgccgatcttcgcggcgaggggttcgatgatgcgcaggttcgcctggtgcagcacgaccccggcgagatccgcgggcgtgagccccgcgcgttcgcatgcccggcgcgcgatggccgggagctgggtggtggcccagcggtagacgctctgcccctcctgggcgaaacgcgggggcgtgccttcgatgcgtaccgcgtggcccatctcggggaccgacccccacagcacggggccgatgccgggctcggcgccctcggggcaggcgtcgaccacggcggcgcccgctccgtcgccgacgaggacgcaggtcgtacggtcgctccagtccgtcaccgcggacatcttgtcggcgccgatgacgagcgcccgcgtggccgcccccgcgcgcacggcgtggtcggccgtggccagggcgtgcgtgaagccggcgcagaccacgttgatgtccatcgcggccggggacgggatgccgaggcgggcggcgacccgggcggccatgttcggggaacggtcctcggcggtggaggtggcgacgagcaccaggtcgatgtcggccggggccagcccggccgaggcgagcgccttggccgccgcgtgcccggccagctcgtcgacgggctcgtcgggcccggcgaagtggcgcgtccggatgcccacccggctcctgatccactcgtcgctggtgtcgaccaggctcgccaggtcctcattggtgagtaccttggcgggctggtagtggccgacggcggcgatgcgtgagccgttcatgggggtccccctcgttgccttgggtagcgggacccaccagtctgttcagtgactcacgggtacgacggcaggtgaagcgacaggaatgcggcggcaggcttgtcggcttctgtcagacctccgggacacccgaatggcccctcgaacatccgaacagacctccggacacccgaacagtcctccgaatatccgggcgctcacccggtgaacagctgcttggccctgaggacgagctcgtacaagccgtaacagagcggtgcgcccacccacagccaggcgaagccgatcagggcccggcggtcaggcggactcgggctgctgtcgctggacatcggcggcctccctcggggcggggatgtggtggcgggcgtggacggggcggaccagctcgttcgcgacgaagccgatgacgagcagcccgatcatgatcaggaaggacaggccgtagagggaggacccgtgctcgcccgcctccttctggtggtcggcgatccagttcacgatcagcgggccgaggactcccgccgtggaccaggcggtgagcagccggccgtggatggcgccgacctgataggtgccgaagaggtccttcagataggcggggatcgtagcgaagccgccgccgtagaaggagaggatcaccagcgcgcagacgatgaacagcggcttggatgagtccccgaaccaggcgatcagcgcgtacatcagggcacccacaccgaggtagacgcggtagatgttcttgcgcccgatcaggtcggacgtcgaggaccatccgatccggcccgccatgttcgcggccgacagcagcgcgacgaaaccggccgccgcggagaccgacaccggggtggacgtgtccgcgaagaagtccgtgatcatcggggcggccttctccaggatgccgatgcccgcggtcacgttcatgcagagcaccacccacaggcaccagaactgcggggtgcgcacggcgtcgcgggccgagacctgcggcccctggaaggcgctcggcgcgccctcgacgggcctctcggtgcgcgggacccgcaccagcagcaccccgagcgacatgaacacggcgtacacgaggccgtgcaccaggaacgcctgcgcgatcccggagctgtcggtgccgaacgactccagcatctgcgtcgaccagggcgaggcgatgagcgcgccgccgccgaagcccatgatggcgatgccggtggccatgccgggccggtccgggaaccacttgatcagtgtcgagacgggtgagatgtagccgatgccgaggccgatcccgccgacgaagccgtagccgaggacgatcagccagtactgctcggtggccgcgccgagggcggagatcaggaagccggacgagaagcagaccagggcgacggtcatcgcccagcgcggcccgttgcgctccaccagcgtgccgccgaacgcggccgacaggccgagcatcacgatgccgagctggaagggcagcgcgctctgggtgccgctgaggccgagcgcggattcgaggggcggcttgaacacgctccaggcgtaggcctgcccgatggagaggtggacggagagagcggcggggggaacgagccaccggctccagccggcgggggcgacggggggactcatgatcccggacggtagggagtgcgggggaggttgagaagtcgcgcgtcgaccgtatgcggtgagcggtatgccgtgcgcgacgaacggtcgtaccggccggtattcaaggcttggccggaccggcctccaaggctcggccggaccggagcccaaggttcggtcagaccggcgcccaaggcttggccaggtcgtgcgcgaacccttgccgcccccacttccatactgtagacaatatttcgtcgacaccttctggacagcgttcgacagttcctcggtaccctcgaccgaacggagctcccccagtgaaagtcgcagttctcggcgccggtgcgatcggcgcctacgtcggcgcctcgctccagcgcgcgggcgccgatgtgcacctcatcgcccgtggaccgcatctggcggccatgaggcggcacggagtgcgggtgctcagtccgcgcggtgacttcaccgcacgcgcccacgccaccgacgacccggccgagatcggcccggtcgacttcgtcttcctcgggctgaaggccaactcgtacgcggcgtgcgggccgctgatcgagcctctgctcagcgacacgaccgcggtcgtggccgctcagaacggcatcccctggtggtacttccaccggcacggcgggccgtacgacggccaccgcgtcgaaagcgtcgacccggacggcgcggtcagtgcggtgctcgcgcccgaacgggccgtcgggtgcgtcgtctacgccgcgaccgagctcgaaggaccgggcgtcgtacgccatctcgaaggcacccggttctccgtcggcgagcccgaccgcagcgtctcggtgcgctgtggcgcgttcagtgaggccctgcgggcgggcggtctcaagtgcccggtcgaacccgacctgcgcaacgacatctggctcaagctgctgggcaacatctccttcaaccccatcagcgcgctggcccgcgcgaccatgcggcagatgtgcctgcacggcggcacccgccgggtcatcgagatcatgatgaccgagacgctcaccgtcgccgaggcactgggctgcgaggtcggcgtctccatcgaacgccggctggccggcgccgagcgcgtcggcgaccaccgcacctccacgctccaggacctggagcgcggcaagccgctcgaactcgacgtgctgctcggcgccgtcgtcgagctggcggagatcaccggcgtcgaggtgccgacgctgcgcaccgtccacgccctctcggatctgctcgcagcgaggaccgccgcatgacgaaacgcgaccgaactccgaagacctacacccgcctcacgcatccgctcgtcagggactcgcgcgacgagcccctccgccgggccacgtgggaggaggcgctggaccgcgcggcccggggcctcgacgcggcacgcggcgccttcggcatgttctcctgcgcccgggcgaccaacgaaatgaactacgtggcgcagaagttcgcccgggtcgtgatgggcaccaacaacgtcgactcctgcaaccggacgtgtcacgccccgagcgtggccggtctgtcggccgccttcggctcgggcggcgggacgtcgtcgtacgaggagaccgagcacaccgacctcatcgtgatgtggggctccaacgcccgcttcgcgcacccgatcttcttccagcacgtcctgaaggggatcaggaacggcgcccggatgtacgccgtcgatccgcgccgcacctccacggccgagtgggcggagagctggctcggcctcaacgtcggcaccgacatcccgatggcgcacgcgatcggccgcgagatcatccacgcgggcctcgccaacgagaccttcgtcgagcgggcgacgagcggcttcgaggagtaccgggcgctcgtcgagccgtggacgctgtcgctcgccgagaaggtgacgggtgtaccggcccgcgccatcagggagctggcgcacgcctacgcccgggcggagcgcgcccagctgtgctggaccctcggcatcaccgagcaccacaacggcaccgacaacgtgcgcgcgctgatcaacctgtccctgctgaccgggcacgtgggccggtacggctcgggcctgcagcccctgcgcggccagaacaacgtgcagggcggcggcgacatgggcgccatcccgaaccggctgcccggcttccaggacatcctcgacccggacgcgcgactgaagttcgagtccgcctgggacaccgtcatccagccgcactacgggctgaacctgacggagatgttcgaggcgatggaggagggcaccctcagggccgtctactgcatcggggagaacccggcgcagtcggaggcggacagcgagcgggccgtacggcgcatgcgggccctcgacttcctcgtcgtccaggacatcttcctcaccaggacggccgagctggccgacgtcgtgctgccggcgaccgccgggtgggccgagacggacggcacgacgaccaacagcgagcggcgggtgcagcgcgtgcgccgggcggtgaccccgccgggtgaggcgcgcgaggacatcgacatcctctgcgcgctcgcggcgcggctcgggcacgactggaagtacgcggacgccgaggcggtctggaacgagctgcggtcggtgtcgccggaccactacgggatgacgtacgagcggttggcggagcaccagggcatccagtggccgtgccccgcaccggaccggctcgaacccccttatctgcacggccggttgtggtcgtccgacccggccgggcgcggccgcctcgcccccttcgggatcgtccagcacgacccgcccgtcgatctgacggacgaggagtacccgatccggctcaccaccgggcgccgcctcgactcctacaacaccggtgtgcagagcggcggtttcgcctctccgctgcggcgcggcgagttcgtcgagctgtgcccggaggacgcggagcgctacggggtcgtggtgggcgagcaggtccaggtggcctcgcggcgcggggccgtggtggcgccggtgtggatcgatccggcgctgcgccccggtctcgccttcatgaccatgcactttcccgacgaggtggacaccaaccggctgacgatcgaggccaactgcccgatcgccgggacggccgagttcaaggcgtccgcgatccggatcgagaagctgccggtcacggccgtgaggagctgaggcaggacatggatctgcacttcggtgacagcaaaccgtcggacgaggagcgggcggccgtcgacgcgctgctcggtcccccggagtcctcgtgggagggcgccgaccggtccgacgccgacctcaggtgggcccgcggcgggcgcgcggcccgggaccgccgcgacctgctgctgccggggctgcacgcggtcaacgaccggatcggctggatcagcgagggcgccctcgactacctgtgccggcggctgacggtgccgcccgcggaggcgtacggcgtcgccacgttctactcgatgttcgcggtgaaaccgcgccccgcgaccgtcctgcatgtgtgcacggacctcgcgtgcgcgtccgccggggcggctgagctgtgcgccggtgtcgaggcccggctcgggcccggcagcggcgtcggagtggaacgcggcccctgtctgggcctgtgcgagcgggctccggccgcactggcggtcagggccggggatccggtgcgtacggcggtgtcggcgcccgcgaccgtcgaggccgcggtgctggcggcgagcgcgcccgactcggcgcccgaggagccgtccgccgccctcgcggtcccccaggcgggtcaggacgggctggttctcctgcgccgcgtcggcgtggtcgaccccgcgtcgctcgacgactaccgggcgcacggcggttacgcggcgctgcggcgggccttcgagctcgggccggccgaggtcatccgggaggtcaccgacgcgggcctggtcgggcgcggcggcgccgccttccccaccggccgcaaatggcaggcgacggcgtcccggcccgaccgtccgcaccacctcgtctgcaacgccgacgaatccgagcccggcaccttcaaggaccgggtgatcatggagggcgacccgtacgcgctcgtcgagtcgatgacgatcgccgcgtacgccgtcggggcgcaccagggctatctgtatctgcgcggggagtacccgcgcgccctggagcgcatgagccacgccatcgagcaggcacgcgcgcgtgggctgctcggcgacgacgtcctcggtcagggctacgccttcgacatcgagatccggcgcggcgcgggcgcgtacatctgcggtgaggagaccgccctcttcaactcgatcgaggggtaccggggggagccgcggtcgaagccgcccttccccgtggagaagggcttgttcggccggcccactgccgagaacaatgtcgagacgctggtcaacgtgttgcccgtcctcacgatgggggcgcaggcgtacgcggcgatcggcacggcgaagtccaccgggcccaagctcttctgcgtgtcgggcagcgtggaccggcccggcgtctacgagctgccgttcggcgcgacgctgggcgagctgctggagctggccggagtgcgggaacggctgcgcgcggtcctgctcggcggcgcggccggcggcttcgtacggcccgacgaacgggacatcccgctcaccttcgaaggcacccgtcaggcgggcaccacgctcggctcgggagtcgtcatggccttcgacgacaccgtcccgctcccccggctcctcctgaggatcgccgagttcttccgcgacgagtcgtgcggccagtgcgtgccgtgccgggtcgggaccgtgcgccaggaggaggcgctgcaccggatcgtggcgcggacgggggcggcggccgccgacgacatcgccctgctcagagaggtgggccgggcgatgcgggacgcctcgatctgcggtctgggccagagcgcgtggaacgccgtggaatctgccatcgaccgtctgggggcgtacgaatgaccgcgataccgctgggagtgccgcgccggctcgtcgagttcaccgtcgacgggcaggaggccagggtcccggaggggtcgacgatcctcgacgcctgccgggccgccggaaaggacgtgccgaccctctgccagggcgacaccctcaccccgaagaacgcctgccgcgtctgcgtcgtcgaggtcgagggcgcgcgcactctcgtcccggcctgctcgcgcggggcggagcccggcatggaggtgcgcaccgacaccgagcgcgcccggcacagccgcaggctcgtgctcgaactcctcgcgtcctcggtcgacctgtcgaccacgccgaaggccgccgggtggatcaaggagtacgaggcgaagccggaccgcttcggccccgacgccgcccggctcaacgaggagccgaaggtcgacaacgacctctacgtccgcgactacgacaagtgcatcctctgctacaagtgcgtcgacgcgtgcggcgaccagtggcagaacacgttcgcgatctcggtggtggggcgcggcttcgacgcgcggatcgcggtcgagcacgacgcgccgctcacggactccgcgtgcgtgtactgcggcaactgcgtcgaggtgtgcccgaccggcgcgctgtcgttcaagtcggagttcgacatgcgcgcggcgggtacgtgggacgagtcggcacagaccgagacgaccacggtgtgcgcctactgcggagtgggctgcaatctcaccctgcacgtacaggacaatgagatcgtgaaggtcacctcaccgcacgacaacccggtgacccacggcaacctctgcatcaagggccgtttcggctaccagcacgtacagaaccgggactgatcaggacatgggacgagtcacggaacgacgcaaggtgatccgcatccgggacggggccgtgagcacccgcccggacacgctcgtcgccgaggaaccactggagatccgcctcaacggcaagccgctcgcgatcaccatgcgcacgccgggtgacgacttcgcgctcgccgcgggcttcctggtcagtgagggcgtcctgggcgaggccgacgaactgcagaacatcgtgtactgcgcgggcgcgacggtggacggctcgaacacgtacaacgtcgtcgacgtgcggacggcgcccggtgtcgtcctccccgacatcacactcgaacggaacgtgtacacgacgtcctcctgcggactgtgcggcaaggcgagcctggacgcggtccgtacgacggcacgctggacgatcgacgacactcccccggtccggctcgaacccgagctgctcgcgagcctccccgaccggctgcgggcggcccagcgggtcttcgaccggaccgggggcctgcacgcggcggcgctcttcacggaggagggcgagctcgtcgacatccgagaggacgtgggccggcacaacgcggtcgacaagctggtcggccgcgccctgcagagcggctccctgccgctgtcccgcacggtcctgctggtgtcgggccgggcctccttcgagctggcgcagaaggcggtcatggccgggattccggttctggcggcggtgtcggccccctcgtcgctggccgtggacctggccgcggagtcggggctgaccctggtgggcttcctgcggggcgcctccatgaacgtgtacgcgggcgagcaccgcatcgctctgcgggccgcggccgcccagggctgagcggctccccgctgcacggcggcggggccccgaccggcggggagcgccccctgcgccgaaggggccccgccccaaagcggtcgctcagtcggccgcgctcgccctcgcccgccgcctcacctcacctcacctcacccgaggcgaagtgcacctcggcggcggtgaccaccgtgcccagccgggggaagtccagccgtacggacgcgtcgtgctcggccgcggtgagggcggccatcgcgtcctcgacgaagaccaggtcgtagccgaggtcgccggccgcgcgggcggtggactcgacgcccagattggtggcgatgccgccgaacaccagtgtgctgatgccgcgctcgcgcagctgctcgtccagggccgtgccctggaaacccccgatggtccgtttcacgatctccaggtcgccgtccgccgcgagaccggcgaccagcccgcttccgggtggctgctcggcgaggccggggcgctcgacgcggatgaggacgacgagggcgcccgcggagcggaagccggccgccagcccctcggccacggagaggacttcgacgcccttccggggctcgacgggcagtccgacgatgcggtccatcaggtcgacgagcactagggcggtgcgtgcggggtcgagggcgagccggggttcggctgcgggtactggtgcggtcatgacggaacgttagcccgcatcagccgtccgtaccggaaatccggatcaacaggctcatgaactggtcgcgttcggccgcctcgagcggggcgaggagcgcgtcgttcgcggcgcgggccgccttctcgcagcgcttcagcaggcgcgtgccctccccggtgagggacaccgcgttcttgcggcggtccttcgggtccggttcacggacgatcaggcccgcggactggaggtcgttgaggacgccgaccaggtccttgggatcgagctggatactgcggccgagctcggcctgggcgacggggccgaggtcggcgacggcggagagcaccacgtggtgccacatcttcatcccctcggccgccagggcctcggccaccaggccgcgcccccgggcggcggcccggccgaggagccagctggggagggtgcggattgcgggcaggggggcggacatgcccccagcctagcgaataaccatggggcatcccaacgaatctccagttatcattgggactcccaacgaatactgtccccgcattctgggaggtgcgatgcgtcgcgtccggtacgagcacaccggtggcccgctgttcctggaggaggtgccggtgcccgacgtcggaccgggcgagctgctcgtccgcgccgcggcgatcggggtgaccctcccggtcgtacggaaggtcaccgaggccgccgagccgatcccgctgggcggcgagatcgccggagaggtcgtcgccgccggggaaggtgtcacccgtttcacggcgggcgaccgcgtcaccggtctctgcttcggacacggttacgccgactacgccctcctgcacgaaaccatgggccacccccgtccccgagagcgcgagccccgtcgacgccgtcgccctggtccgcagcggcctggtcgcgctcggcgccctggaggcggcccgcccccgccccggcgagtcggcgctcgtcaccgcggcggccggcggcgtgggccaactcgccgtacagctcgcgcgcctgcgcggggcgtcgcgcgtcgtcggcgccgtgtccgccccgggcaaggcggcgttcgtgcgcgggctcggcgccgacgacgtgatcacctacgacgccgacgcctggggcgagcccgtcgactacgtcctcgacgcggtcggcggtgagctgctcaccccggcgatcgccgcgctcgccccgggtggccggctcgtcgcctacagctcgggcggcgggaccgtccaggcgtacgacctgctggtgagcgcgaagtcggtgatcggcttccagatggcgcggatcgcccgcggggagccgcagctgtacgaacggtggcggcgggagctgtggcggctgttcacggacggggcgctgcggccggccgtgcacggggagttcgacctggcggacgccgcgaaggcgcacgaggtgatcgagtcgcggagcaacctcggcaaggtggtcctgcgcacctgacgctccgccgctactccgtccggtgtactcggcctcccgcgcacatccccacccgcgcgggctcgttactcccggtgagttccacagggccacgtccgcgcggcccgtcgtccgggtaggaggcagttacttggatgccggcaccaccctgctcggctcgttagtggcctgcgcgggcgtgctgggcgcggccgtcgtggcgtacctggggaagcggggcgagaacgctctgaacggcttctccagtctcaccgacaagctgcagtccgagcgcgaccgcctggagcgccaggtcgccgaacgtgactcgcggatcgtcgagttgtccacgctgcatgccgcggaccagtcggagatcgcccggctgcgcctcgacgtccaccgcctgggaggtgcgccgtgaacgggttccagcggctgctcgccctgcgctggcgcggcatcttcctcgtctgcgtcctgatcgcgctctccggcatcgcggtggtcctgtgggcgcgcatcgacgccggggaccgcaaggccgaggagctgcgctcggaggcggaccggcgcggcaaggccctgtccacgctcgcgcaggacgtgcgggacctgcgtgcccaggtcgaggccggcggtggaacccccgccgcgccggacccctccgaggccgtggaccatctggtcgaccgcgttcgggtgcccgccgggatgcccggcgcacccggcgcccggggtgagcggggctcgggcgggaagaacggtgccgccgggaagcgcggggcgcgcggcgagccaggtcccctcggaccgtccggcgggaccggcccctccggcgagccgggcacggacggctcccccggaccggcgggaccccccgggccggcgggaccccccggaccggcagggcctcctggaccggcggggctccccggggccgagggcgagcggggggcgcaggggtaccagggagcgcccggatcctcgggcccgaagggcgaccggggagacccgggcccggccggccccaagggtgaccccggccccacctgcccggacggctactccctccaggcgcccgcgagcgacccggacgccctggtctgccgcaggaccggagcggcacccgggccggttccccaggcggcggcggtacttccggtcctgccgcctccacggcgacgccgagacctggcgtgaacacgaccggtgcacgcttcttgtgggccggctgagcgcccaagtagcgtctgtgacgcgcacgttggacgtgggatgtccagatgtccagacgcatgaagggcaggtcgcaccatgccgtcaactctccgtgcacgtatcgcatcgaccctgaccgccgtgctcaccaccgccgcactactggccctgccgagccccgcgggggccgaacaggcgacggacacgggtgagttcgagcaacaggtgctcttcaaggcgtcccaggatcccggatacgcctgcttccgcataccggccgtcgtgaagacgaccgacggcaccctcctggcgttcgccgagggccgcgtcctcaactgcggtgacgcggccgacatcgacatcgtcctcaagcgctccaccgacggcggccgcacctggggcccgctccaggtggtcaacgagggcggcggggacacccacggcaacccggcgcccgtagtggaccgcgagaccggccgcatcgtcctggccgagacgtacaacacgggccgtacggacagcgccggctgtaccgtcccgtgcgaccgcacaccgcacctccagtacagcgacgacgacggcctcacctggtcccggccgcgcgacctgagcgacgagatcctcccgccggagtggaactcctggtacgccaccggacccgtgcacggcatccagctgacccggggcagacatgcgggccggctcgtcctcggcgtcaacaccgagacatgggacggcagtcgggtcagcgcgaaccacgccgcgctcatcaccagcgacgacggcggcgaccactggaggatcggcgccacggactcgtggccgatcgccgcggacggcacgttccgtcagaagccgtccgagatgacgctggccgagcgcacggacgggtccgtcctggtcagcgggcgcgagcaggacggcaccgacctcggacaccgcacccaggccgtcagccgcgacggcggctccagcttcaccgcgcccttccgtgatctgccggacctgtacacgccccaggtccagggctcctcgctgcgcctgggcgaccggctgctgctcgcctgccccggcgacccggaccgccggcggaccatgacgatccgctcctcgtacgacggcggacgcacctgggacagcgtcgaccgcggcacggtcgtcaccacggactggtcgggctactcggacctggtgcgcgtcggccgggacaccgtgggcctgatgtacgagggcggtgcggtcgacgcgcgggacgagatccgcttcgcccgcttcaccgaggactggctgaaaccccgccgcggccccgacccgacaacgcccgacctggccccgcacgccaagggcgccgcggtcctcgggggcgccgagcagacggagggcgtgttcggcggcgcgctcgacttcgacggcgccgacgacgccgtacgcctgccgtaccgtgccgaactcccgctcgggacaaaggacttcacggcgtccctctggttccgttacaccgccgcgaccggcgagcagcccctgctgtggatgggcgggatcgggacctcgcagccacaggtgtggctgcgcggcgagcccgcgtcgaaccgcgtccagggtctgatcaccgtccgcgacggcgcctcggccccgcagtccgcgttcgtgcgcacgacgggcgcgtacaacgacggccagtggcaccatctcgcgctgcgccgtggcggcggagcgctcacgctgttcctcgacggtacgccgatcagcaccgcggatgtgcccgggtccgtcagccgcaactcgccgttcggtgtgcacatcggtcagcggatggacagccgggcgtacttcaccggatccatcgacgaagtgcgcgtctatggacgggcgttgagcgacgccgagatcacgggcctgcgcacggacaacgaggcgtcggcccgggacaccgtcctgcggctgcccatggaccgggtgagcggcagccactaacgtcccgtgcgtgcccgacgacgcacgagctcgacggcggaccgggaccgggctcggtgtgctcctggccctggtctgcacggccgtgctgctcaccgccctcccggaccaccaccgggagagcggcggctgcgcggcacgcacggtggaatcctggcgcccggacacagaactgaccggcgagttcgcgcgctacggcgacgacgccacccgtgccgacgactggaccggcggcgacggcacccactcggtgcgactgccggacgggcgggtgctgtggctgttctcggacacctatctgggccaggtgcacggcccgcccaaccccgtcggcgagtcctacgcctggcgggacacctcggcacccctcgtacgcaactcggctgtggtgatgacgggtgcgggccggctgagcgccacgctgcccgccccgctgttcccggatccggccgccggacagtggcgctggccggtggccgcccgggtcgagccccgctcccccggctcgtccgaacaggtcgtacgtgtcctgctgtggacccgtacgacaggtgcgtacccgtggatctacggcgtcccgaccgccaccgaggtcgccacgctctccctgccggacctgcgggtcgagggcatcacccaggtcctcgaccagcggcaggtcccagatcccgcgcaccgcgtgctgttcggcaccacggcggtgacgggcgacggggactggacgtacgtgttcggcggcgacgacgggcaggccgcctcccgcccggcgtcgaaggcgtacgtggcgcgggtgccgcgcgggaggctggcggagccgggggcctgggagtactgggacggctccgcctggagggctcacgcccggccggcggcgatgctcggggacgggcggggcacgggcgtgggcagcgccttcacggtcgtccgcgacggaccgacatacgtgctgttcaccatggccgccggcacccgggggctgacgacggtcacgtcgtactgggcgtgctcaccggccggcccctggcacggtccggccaggggattcagcccgccgctgccgcaggggcaggtggccgcgtacaacccgcaggcccacccggtgctcggcggcgacggccggctcgtcctcagctacgacgtcaactggctggacacgacgggcgcttcggcccaggcgaacctcagccggaacgtgtccctgtaccgaccgcggttcgtgtccctgcggctgactccggggtgaccgccgaccgctccgggtcgcgcgcccggcgcttggcgatcaccgcgcacaccatcagctgcatctggtggaagagcatcagcggcagcacggcgagcgaggcgtgcgcgccgaacagcacactggccatgggaagtccggaagcgagggacttcttcgaaccggcgaactggatggcgatccggtcctcgcggccgaagcccagcgccttgccgccgtaccaggtcagcgcgagcatcacggcgagcagcacggcctcgacgacgagcagtccggcgagcctgacggcgctcacctggtgccagatgccctgcaccatgccctcgctgaacgcggtgtagacgacgagcaggatcgagccgcggtcgacgagtccgaggaccttcttgtgccgcaggacgaacccgccgatccagcgccgcagcacctgcccggcgaggaacgggaccagcagttgcagcacgatcctgacgagcgagtcggcggagaacccgccgccgctgttgccgagcagggcggccgcgagcagcggggtgacgacgatcccggcgagcgaggagaaggaacccgcgcagatcgcggcgggcacgttgccgcgggcgatggaggtgaaggcgatcgacgactggatggtcgacgggacgagggtgaggaagaggagaccggtgtagaggggctgcgtcaggagcgccgggacgagcccgcgggcggcgagaccgagcagcgggaagaccacgaacgtgcaggcgaggaccgtgacgtgcagccgccagtgcttgaggccctcgagtgcttcacgcgtggagagccgggctccgtagaggaagaagagaaaggcgatcgcggccgtggaggcccccgacgcgacatccgcggccgtgccgcgcgcgggcaggagagccgcgaggcccacggtcccgagcaacaaaaggatgtacgggtcgacgggtatccaactcggccaccgcaggcgtttcactgtgctccactacttcgctgtacgtcgttttccggacaccggacgtgccctctccatcgtcctccccggacccgcgatcgggaatccggcataccactctgactgtcatcacgttccgcgataacgtcgcgggatgtacgacccttcacagctgcggacgttcctcgcggtggcgcagacgctgagcttcacgcaggccgcgcgccggctcgggctgcgtcagtcgacggtgagccagcacgtgcgccggctggaggacacggccggacggcagctcttctcgcgcgacacccactcggtggagctgacggaggacggcgaggcgatgctcggtttcgcccgccggatcctggaggtgcacgagcaggccacggcgttcttcacgggcacgcggctgcgcgggcggctgcggttcggcgcgtcggaggacttcgtgctgacccggctgccggagatcctggagggcttccggtacgaccatccggaggtggacctggagctgacggtcgagctgtcgggcacgctgcacgaacagctcgcggcgggcaagctcgacctggtgctcgccaagcgccggccgcaggacccgcgcggggagctcgtccggcacgaccggctggtgtggatcggcgcggagcggctccgcctggaccccgaccgcccggtcccgctgatcgtctacccgccgccgggcatcacccgcgccctcgccctcgaggccctggagaagcagggccggtcctggcgcgtcgtctgcaccagcggcagcctgaacggcctgatcgcggcggcccgcgcgggtctcggtgtgatggcccactcccggggcctggtcccgccgggcctggtccgtgtccctgaacgggcggggctgccggagctgggcgaggtggacttcgtcctggtgcacgggcgccggcggggccccacccagggcgcggcggaagcgttggcggcggcgatcctggcgggcggcgaccggttgcaccgcgggcggacgtagccggccgggccggacctgccctagcccggcatccggtacgtcagctgtttgacccggcgcatgaacggtgtcgtctcgacgtgctggaccccttcgaggtggccgaggcggccgctcaggtaggcgtagagggcccctgtgtcccgcaccacggcggtcgcgacgatgttggaggggccggcggtcgccgaggcgtaggcgatctcgtcgtgggtggcgagggcctcgccgaccgagtgcagcgcgccgggcgaggtggtgatccacaggagggccgcgagggagtagccgaggatctcggagtggtactcgatgtcgatgtagacggcgccggaggccagcagtgcggcgaggctgcgcttgacggcggactcggagcggccggtggcccgctggagctcggggtaggtggcccggccgtcccgttcgagtgcggcgaccaggggttcgtcctccggggcgatccgggcgggcccggacgcggccggaacctcggggcgcagcgcggcgatctggtcgtccgtcagtgcggagaacttcccgatccagcccgtcgggccgccgtagaaccggtgcagcagctgctgggcgcggatctccacgatgctgggtgtgcggggcagcttgccgagcagcaggtcgtcctggtcgccccggctgcgcgggcggctcatgcaggccacctcggtgccgcccgacgccagtccgatccagccggtgtcgggtcgtttggccagggcttccgcgatggccccggagctgtcgggggtgcagcgcagccgcagcatccactggtcctggccgaggcgctccgcgtcccggacggccacgacccgcaggcccgcctcggcggtcagtccccggtagcggcgcgcgacggtctggtccgagacgccgagcacggccgcgatccggctgaagggcgcccggccggccagctccagcgccgccagcagttgcagatccaatgcgtcgaacgcgtcggattccctctccaaggggcactccagtgtcgaaatccagcgggatgagcccgatgaccgtgtcgatcgtccgggtctccctcatcgtacggaccgcatacgcatccgtgacacagggagttgaggatcatgcgtacatgggggccgctcaccgcggtgtgtctggggacgttcatgctgctgctggacgtgacgatcgccgtcgtggcgctgcccgacatggcgcgggcgctgcatgcctcgctcagcgatctgcagtgggtgatggacggttacgcgctggccctggccgcgctgctgctcgggctgggggccgcggccgatgtgctggggcggcggcgggtgcatgtggcgggcgtcgtgctgttcgcggtggcgtcactgctgtgcgggctggcctcggggccggggatgctggtcgccgcgcgcggggtgcagggaatcggggcggccgcgatgttcgcgacgacgctgccgctgctgggctccgtctaccagggtcggcggcggtcggcggcactcggcgtgtggggtgcggtgagcggggcggcggccgccgtcggtcccgtgctcggcgggctgctcaccgacgggcccggctggcgctggatcttcttcgtgaacctgccggtgagcgtcgtggcggtctggctgacgctgcgcgtggtgccggagtcgcgggggccgcgggggcggcgcatcgactgggcgggcacggtggcgttcgcgggcttcgcgggcgcgctgacgtacggggcggtgcgggcagggtccgaggggtgggccgaggcgggcacactcgtgtcgttcgcggcggcggccggggcgctgggctgcttcgtgctgatcgagcggcgcaccgccgatccgctcctcgacctgtcgttgttccgcaagcccgcgttcctgggcgtgatggtgggggcgctcgccttcaacgcggcggcgttcggtgtgatgccgtatctgtcgatctggctccagacgctgctcgggatgagcccggtgcggggcggtctggtgttcctgtggctgtcggccgcctcgttcgtggtggccgcggtcggcggccggctgctgcacggggtgccgtcccggctcaccatcggcggcggactgctgctgatcggctccggtctgttctgccaggcggtgctcgacgcgggtgcgacggcgacggcgctgataccgggtctgatcctggtcggcgtcggtacgggcctggtcgcgcccggcatcgcgggcgccgcgctcgccgccgtcccgctggagcgggcgggcatggcgggcggcgcggtcaacaccttccgccagctcggctacgcgctcggcatcgccgtcttcggcacggtcctcacctcgcgcatgcagaacgcgttgccgcgggacgcggcgcacacgctggcgggcggtggcgcgggagccctgcgcgggacgctctccgaacacgcgctgcgggccgcgttcgcctccggcctcgacgcggcctcggtggccgccggagtgacggcgacggccgccggtgcgctggtgctggtgctggtgcggacaccgcgtcccgcgccggatgcggccggggcgccggcacaggaggtcgcggcgcaccgcgggtgacggcggcggggccggtcccggcgccaccggggccgggaccggccccggcagtgagggagcatgagcggtccgacggcaggagggcgaggaaacggggcctccgcgttcggtatccgatgcgcggtgcaccgtaatcgggtcgcgcagattccgtggagattacgaccgggaaacctacggaaccgtaggtggttctgcaccgtctctccccttgtgggaggattttcccgcgtgaccagtgcatacaccgtgaccctccgtcgttcggtcacccctcccgcccggcagtccggtggggtagctttcacggcgctgtgcggagcgccacaaggagcgggattgcgcgagttcaccaaccctccgttggcgtcggcgccgccggtgggcggcctggccgacgttgtcttcgaccatgccctggaggatccgctgcacgtcgctctcggccgcaaggacgagcagggcacctggcgtgacgtgaccgccgcggagttccgcgacgaggtcctcgccctggccaagggcctgctggcgcaggggatccggttcggggaccgggtcgcgatcatgtgccggacgcgctacgagtggacgcttttcgatttcgcgctctggacgatcggcgcccaggtggtgccggtctaccccacctcgtcggccgagcaggtcttctggatgctgcacgacgcccaggtgtcggccgcgatggtggagcacgaggaccacgcgatgaccatcgcgacggtcatcgaccggctgccccagctgcaccggctgtggcagctcgacgtgggcgccgtgcaggagctgtacgagtcgggcgcgcacctcgaggacgaggtggtgcaccggcaccggcgcgcggtcacgcccgagtcggtcgcgaccatcatctacacgtccggcaccacgggacgccccaagggctgtgtcatctcccacgcgaacttcatgttcgaggcggacacggtcatcgagcgctgggagccggtgttccactccaagcgcggcgacgaggcggccacgctgctgttcctgccgctggcgcacgtcttcgggcggatggtgcagatcgccgcggtccgcggccgggtcaagttcggccaccagccgcagctcaacgccgcggcgctgctgccggacctggccgcgttcaagccgacgttcttcctggccgtaccgtacatcttcgagaaggtcttcaacgcggcccgccgcaaagccgagagggagggcaggtcgggcgcgttcgagaaggccgtggaggccgcggtcaagtacgcggacgccgtggaggcgaaagcctggggcatcggacccggtccgtcggcggccctgcggatgcagcaccaggtcttcgacaagctcgtctacgccaagatccgggccgcgatgggcggccgggtgcggcacgcgatgtccggcggctcggcgatggaccgccggctcggcctgttcttcgcgggcgccggcgtgtacatctacgaggggtatggcctcacggagtccaccgcggccgcgaccgcgaacccgccggagcgcacccggttcggcacggtcggccaggcgattccgggcaccaccgtgcacatcgcggacgatggcgagatctggctgaacggtggcaacgtcttccagggctatctcaacgaccccaaggccacggacgcgacgctgcacgacggctggctggccaccggtgatctcggctcgctcgacgaggacggctacctcaccatcaccgggcgcaagaaggagatcctggtgacgtccggcgggaagagcgtctcgccgggggtcctggaggagcgggtgcgcgaccatccgctggtcgcgcagtgcatcgtcgtcggcaacgaccgcccgtacatcgccgcgctcgtcacgctcgactcggaggccgtcgagcactggctccagatgcacgacaaaccacagctgaccccggccgagctggtccgggacgccgagctggagacggaggtgcggcgggcggtggtcgccgcgaacacgctcgtctcgcaggccgagtcgatccgcacgttccggatactggcccaccagttcaccgaggagcacggcctgctcacgccgtccctgaagctgaagcgcaaggcgatcgagaacgcgtacgcgaccgaggtggaggcgctgtaccgggcctgacccccggcacggcgcccgtccgtcgccgctgtccgatgctcacccggaagatcttgtccgagccgtccgccgcgcctccgttgatccatttccggccaatctccggcgggaccacacggaatccgcaggggattcacgacgaatccaccggtcaggaatgcatcaccgcccgtgatcgttgacgatgggagtaccacccgacgactgtaaggatcgagagctcgtgagcaccaaggtccccccgatcaccctgaacaacggcgtcgagatgccccagctgggcttcggcgtctggcaggtgccggacgacgaggcggagcgtgccgtcgccaccgcgctggaggccgggtaccgcagcatcgacacagcggcgatctacggcaacgaagagggcaccggcaaggcgatcgcgaccgccggcatcccccgcgccgacctcttcgtcaccaccaagctctggaacagcgaccagggctacgactccacgctgcgcgccttcgacgtgtcgctggagaagctcggcctggattacatcgacctgtatctgatccactggccgctgccgacccggggccagttcgtcgagacgtacaaggcgttcgagaagatctacgccgacggccgcgcgaaggcgatcggcgtctccaacttcctccccgagcacctcaggacgctcatcgacgcgacgtcggtcatcccggcggtcaaccagatcgagctgcacccgcaccttcagcagcacgccgcgcgcgagttccacgcggagcacggcatcgcgaccgaggcctggtcgccgctcggctcgggcaagggcctcctggaggtcccggcgatcgtcgcgatcgcccggaagcacgaacgcaccccggcccaggtcgtgctgcgctggcacatccagctcggcaacatcgtgatccccaagtccgtgactccgtcccggatcaaggagaacatcgaggtcttcgacttcagcctggacgacgaggacatcgcggcgatcagcgcgctcaacgaggaccgccgcctgggtcccgacccggcgacgttcgacatgggctgacctgccggaacacgcgccggaacacgcgcgagaaaacccgtcggggcccggacaccggaaaggtgtccgggccccgacgcttccccggcgccaccccgcgcttcgcgccccgctcccccggacggcctacccgacggctcccccacggctccctcacggctcccgcgcctcgtaccggcgctccccatcggcttccccctggaccggaccaagtccgcggaaggccttgacgcggtcatgcaagcagggccacattgtgcgcaacatggtaaggaaactttcctaacagaagggtcccccacagtgcgcactcgaacactgaccctcgccgcggccgccggcgccgcgctcctcgccaccgccgcacttccggccaccgcctccccgtccggcaccaaggcccccgcctcggcacaggagggctcggtcagcgcggcctccctgctcgccaaggtgacgtcctgttcgcagatatcgaacggcaagtacaagaccgacgacgagacatcggccacgatccccgtgtgcggcaagaacggcgcggtgttctggaaggccgacatggacatcgactgcgacggccaggtcaccggcaagtgcaacggcaccaccgacccgtggttccaggacgacacggcgttccaccagtccgacggcaagccgctgcgcgccgactcgctcccgtacgtggtcgtgcccagctccagcagcatctggaactacgcgagcgccggcatcaagggcggcggcgtggtcgccgtcatctacaacaacaaggtcgagtacgcggtcgtcggcgacaccggccccacgaagatcatcggcgaggcctcgtacgccaccgcgcaggccctcggcatcgaccccgacccggagacgggcggcaccgactccggcgtgacgtacatcctgttcaagaactcgcaggtctcgcccatcgagagccacagcgccgccgtgtcgctgggtgactcactggcgaagcagttcctccagaacaactgagccggacagggaagccggagaccgaagcggcccccgcaccgcgcgcttcgccgcggtgcgggggccgcgccgggaggtcagacgggctggccgatcggccggacgaccacggtgttcacatcgacaccgctcggctgcccgatcgcccagacgatcgactcggcaagctggtccgccgtcagcagctgccctggcggcaggctgccatagctgtcccagaacggcgtctccacgcgtccgggcgagatcagcgtcacccccaccccgaactcggtgacctggcgtcgggtgttctcggcgagaccggtcacggcccacttcgtggccccgtagatgttgccgggggtgttgacgtggcccgccacactgccgaccagcacgatccggccacgcgtctccttcagggcgtcgacggaggccctgatcagcagcgcgggccccagcacattggtcagcaccatctcggaccagccggccgggtcgccctccgcgacggtgtcgtgggtggcgaagccggcgttggcgacgacggtgtcgagccgcccgaactccttgagcgtcgcctcgaccgcggcctgtacgtgttcgtactcggccgcgttccccgccaccgtcaacaagccctcgggacgcccgagttcctcggcgaatccgcgcagccgctcctcgccgcggccggtgacggtcacccggtgtcccgcgtcgagcagccgccgcgccaccgcggccccgattccgcttccgccgccggtgatgagcgcgacaggagagtcggtcatggttaccccctatgtttccggtgaacgcggggagtccatcacttggagcgctctcgaagtcaagaccgaagtcgtggccaagggctcagcaggtgggctgacagggcacgtcgggcggaggggtgttccactgcgcccgggtggagggctacggacgacggctgcgcggacgagggctacccggccttcaccgcgacgtacacggtgtgtgccgtgagcaggaagacgtccgggcggtggtgcaggctcgccttgtcgccggggtcgaggagccggtcgagggtggcgaggtcatccgcgtcgaggccgtcggcgagcttgtcccggcggtgggtgagggaggtgacgacgaaggcgcgggcctcctccgacaccggggcggggaggtcgaggaggaacgtgcgggtcgcgatgtgacgcagaccgacggccgtcagcagggcgggccagtcctcggtctcggtcaccgctccgggaagcgcggcccgcatctcggtgaaccactcctcctgcaccgcgtccagacgggactgcagggcgggccggccgattccgatgtcgcgcgggaggaagcgcgcgggcaggccaccttccagaagggcgagcatgccgccgggagccagcccccgcgcgaatcccgagagggcggctcgctggtcaccgacgtggtgcagggacctgctggcccacagcaggtcggcgggatactccacgttgccgagtccgtcggcgagttcggcctgcacggtggtgaagcggtcggctactccgagccggtccgcacgggctcgggcccgttccaggaggggttccgcgccgtccacggcgacgacccgcgcccgcgggaaggtgtccgcgaggaggcaggagatgacaccggggccactgccggcgtccacgatcagctcgggctcgggctgccgctcccgcagccaggccgccgcccgggcgtacagcggggtgaacagttcggcctcctgctccagcaggggaagccactcggcgaagtcgatctccgtgtggtcgtgctgtgggtggtcgtggtggtgtgccatggttccgagcctctcgttcggggtgcggcaagcgtgcgccgccacttcccgaaacggccaatcgttttgcgtgaacagcaaagtggtgtggcagggtggaacgcttcctcgaggacgggttcgtgcggatcgagggtgcctttccgccgcgcgtcgccgagggccgggtccgccggggactcgacgagcccccggcggacccggcctaacggcgcgtcacagcgccgggtacgcgttcttcatgagttcctggaactgcgccgagaaccagtgccccgacagcggggcgttcggcagggcgcccgacatgctgttgccgttgcgggcgttgcccgtgtacgtcgggtcgcacatccggtcgaatcccttgccctcgtcgttcgcgatggccgagctggagccgtcggactcacccgggggcttcatccacacgtacgcgtcgatcccggtggccggtgcggcctgcgggcgctcaccgagaccggcaccggactggttgcaccagttgccgacgtggatacggcggtcgtagcggccgccgttgacgtacgtgtcgacgctggtcgtcgcgccgggaccggtgggccgtgcggtgccgccccagccgttcctggaggtgtcgatcagcatgccgatgccggagttgaagccgaccgagacgagctgggtgcggaaggcctgggcgaaggacagctcgtcgacgtagcggttccagtcgacccacttggactggcggacggaggtgccgttcaccgagtcgttgatggtgaagttgttctccttcagggcgctgtagttcgccgtgttggtgatgaagccgtgcacgtcgtcgaccgtcgcgccctcactcgtcgccgcctgcttgaacagggtggcggacggggcgaagttgtcgtcccagccgatccagccgtggtgtccggcgtcgaggtagttgtagacgttcgggatcgcgccgagcttgttcagcgcgtagccgacgcccttcacatagttgccgttggcgagcatcgtgtcgcacgcgggcgtggcggtggcgcggctgccggtgttggtgacgaggttcggcagtgagtcgatctcgatggtcgtgacgatccgcagacccgcgtacttgctgtccgcgaggatcgccgcgatcgggtcgatgaactgcgtcttgtacttgtcgatctccgtcgggccgagttcgccgttggaggcgagggccgcgcagtcacggccgggcaggtcgtagacgaccagttggacgacctcttcgccgctgcccttctgggcgagggccgcgtcgaggtgggcgcgcaggcccatgccgccgttcacgccgttgatcgcggcgatgcggtcgagccagacgccggtgggctggctggagatgcggctgccgccggtctcggccgcggccttcgcggaccactccgggttcacgtacaccttggcgcctgcgtaggggttgtcgaccttgccggacgggtccgggtccgtgccgcccccgcctccgccgccgtcgtcgacgttgcaggtcacgccgtcgagcgtgaaggcggtcggcagtgcgttggtgccgctgtacgaggcgttgaagccgaagctgaccgaaccgccgctcgccagcgccccgttgtagctctcattggcggcggtgacggctgtgccgctctggctgatcctggcgttccagccgctggtgaccttctggtttccggcgtacgaccatttcacggcccaggaggacttggcggccccgttgttggtgaccgtgacggcggtggtgaaaccggtgtcccactggttctgcaccttgtagtcgacggtgcaggggacggcggcgatgccgggttccggggcgaccgcggcgaccgcggtccccgaggccccggcgaccagcgccaaggcagcgagtatcgctgttctggtacggctcatgagtgcgggtgtcctatccgttgagggcgcgcaggtggtcgcgcagtccgataccgaacgacgtgggagtgccgtcgtagttggagatcagggagggaccggaggagcagtcccaggtgttccaggtccagccgaggtaggagaggccccggtcgtcgaaccacttcatgacggtgtcgatgaaggagtgggagcaggtgttctcgccgatctccccggccaccagcgggacttgggcggccaccggggcgagcgtcgagttccagcacgtctcactggcgcaggtattgaagttgtagacgtggtacgcggcgacgagattgcccgtggcatcggtgggcttgtacgtcagccactggctcaggtcgttcgagtacgcgagcccgcccgccaggatcaggttcttggcgccggtgccgcgcaccgcgtcgaccaggtcctgcatgccggccacctcgtaggtgatgccggggcaggtcccgccgtcccgccagcactgccacgcctgggtggtcgtggaggtggcgcggtccgggtagggctcgttgaacaggtcgaacgcgaccgccgcgtcgtccttgaaggtgctcgccaccgaggcccagaaggacggcgtgtactgggcgtccggcatcggcttctggcaggtggcgtgcacgtccgaacagccggcggagttgccggtgtactggccgtacgtccagtgcagttcgacgaccggcgtcatgccgtgcgcctccaccctggccaccaggtccttgacggccgcgatgtagttggcgccgccgtactccggcttgatgttggacaggccgagccagcactcctcgttcagcggaatgcggacggtgttggccttccagtcggcgatcgccttgacggcggcgtcgtcgaccggcccgtcgaagatgccgtagccctggacacacatgaactcgccgccggaacggttgacgccgagcagccggcgcgtcttgccgtcggcgtccacgagcttgttcccggatacgtgcagtttcggcgccgcacccgtcgccggcgggtccgacggtgacggtgaaggcgacggttccgcctccacattgcacgtcgtcccgttgagcttgaacgacgtcggtacggcgttgctccccgaccacgaggcgaggaacccggcgctgacactcgcaccggagcccagcgagccgttgtagctctcgttggccgcggtcacggtggtaccggactgggaccacttggcgttccagccctgggtgaccttctgcccgccggcgaagtcgaacgtgagacgccaactgctcagggcggccatgttgttggtgatcttcacgccgccctggaagccggcgtcccactggctggtgacggcgtactccaccgtgcacgcgggcgtcgtggctcccgacgccgtgacgaccggcacgaccgcgctcccgatgagggcgaccgcgccggcgacaagaagaagtgctgaacgagggggatgtcgcatgagcgactcctcacagctcgggcgcgccgtggacaggcgcgtcgactgatggaatcgctcccactggtgctggggaaggtagcgccaagtgacggcgaagaacagaggagtcaccaggtttctcgcagttgcgctgatcgaatcttttcgactcttcaagcaccttgacccctcccacccccctctccaatatgggagcgctcccactggttcaaggcttgttgctcctccccccgtttccgagccgcaaggaggaaccagcacatggcatccagaaggagacgccgcaccgtgcggcggttgtggaccgccgtggtcgcggccctggccctgcccgtgacgaccctggcaaccggaatctccgcgccgtccgcgcaggccgcggcgctccagtgcagcgtcgactacaagacgaacgactggggctccggcttcaccacggacgtgaccgtcaccaaccggggcacggacccgatcaacggctggaccctgacgtacgcctacaccggcaaccagacgctcaccggtggctggagcggtacctggtcgcagtccggcaagtcgatcaccgtgaagaacgcgtcctacaacgggacgatcgccgccggagccgccgtcaacaccggggcgcagttctcgtacagcggcaccaacacctcccccacgggcttcgcggtcaacggcaccacctgcgccggcgcccaccagccgccggtcaccgtgctgaccagccccaccgccggcgccgtctacacgcagggcgacgcggtcccgctcgtcgccaccgcggccgccgccgacaacgcgacgatcagcaaaatcgagttctacgacgacacgacgctgctgggtacggacaccagctcgccctacacgctgtcggccgccggcctgagcgtgggcggtcactcgctgatcgcgaaggcgtacgacagcctgggcgcgtcggcggagtccactccggtcggcatcacggtcgcctcgggtcccgccgtggtggcctcaccgacccaactgggcgtccagcagggcaagtcggggacattcgccgtgaagctgtcgacacagccgagcgcgaacgtcaccgtcggtgtgacgcgtacggacggaaacaccggcctgtccgtcaccggtggatcgtcgctcaccttcacgccggccaactggaacacggcgcagacggtgaccatcaccgccgacgcctccggcaccggttcggccaccttcacggccttggcgaccggccacaccaaggccacggtcacggtcacggaactggccgggtcgaaggcgtacgacgcccgcttcctggatctctacggcaagatcaccaacccggcgaacggctacttctcccccgaaggcatcccctaccactcggtggagacgctgatcgtcgaggcgccggaccagggccacgagacgacctcggaggcatacagctacctcctgtggctccaggcgatgtacggcaaggtgacgggcgactggtcgaagttcaacggtgcctgggatctcatggagaagtacatgatcccgacccacgccgaccagccgaccaactccttctacaacgcctcgaagccggcgacgtacgcgcccgagctggacactccgggcgagtacccggcgaagctggagcccggcgtcccggccggctcggatccgatcgccagtgagctgaagagcgcgtacggcacggacgacgtgtacggcatgcactggctccaggacgtcgacaacgtctacggctacggcaacgagcccggcaagtgcgaggcgggcccgaccgccaccggaccgtcgtacatcaacaccttccagcgcggtgcgcaggagtccgtctgggagacggtcccgcagccgacctgtgacgccttcaagtacggcggcacgaacgggtacctggacctcttcaccggggactcctcgtacgccaagcagtggaagtacaccgacgcacccgacgccgacgcgcgtgccgtgcaggccgcgtactgggccgacgtctgggccaaggcccagggcaagggcggtgatgtgtcggggaccgtcggcaaggccgcgaagatgggcgactatctgcgctacgccatgtacgacaagtacttcaagaagatagggaactgtgtcgggccttcgacctgcgccgcgggcaccggcaaggacgcctcccactacctgatgtcctggtactacgcatggggcggcgccaccgacacctcggcgggctgggcctggcgcatcggctccagtcacacccacggcggctaccagaacccgctcgccgcgtacgcgctcagctcgtacgccgacctgaagcccaagtcggcgacagggcaggcggactgggcgaagtcgctcgaccggcagctggagttctaccgctggctccagtcgagcgagggtgccatcgcgggcggggcgaccaacagctgggcgggccggtacgcgaccccgcccaccgggacgccgaccttctacggcatgtactacgaccagcagccggtgtaccacgacccgccgtccaaccagtggttcggcttccaggcgtggtccatggagcgggtggccgagtactaccagcagacggggaacgcgaacgcgaaggcggtcctcgacaagtgggtcggctgggcgctgtccaagaccacgatcaacccggacggcacctaccgcatcccctcgacgctccagtggtccggctcgcccgacacctggaacgcgtcaagtcccggcgccaacacgggacttcatgtcaccgtcgccgactacaccgatgacgtgggggtggccgcggcctatgccaagaccctgacgtactacgccgcgaggtccggcagcacggcggcgaagacaacggcgaaggcactgctcgacggcatgtggaacaactaccaggacagcctcggcgtcgccgtcccggagacccgcaccgactacaaccgcttcgacgacagcgtgtacgtcccgagcggctggaccggcaagatgccgaacggcgacgcggtcaactcctcctcgaccttcacctcgctccgctccttctacaagaacgacccggcctggtcgaagatcgagagctacctcgcgggcggcgccgcgcccacgttcacgtaccaccgattctgggcccaggcggacatcgcgctcgccatgggttcgtacgcggagctcctcgaatagtccccgcaaggctccgtgtaccgggccgggcggttctcctaccgggggccgcccggccgtcgcgcctttccatccccccgcttcaggagaggactcaccgtgcgaagaacccgcatcttcacggccgtgctcgcgctggcggccggtctgcccgccggcaccccgccggcactggccgcgagcgcccccacggcgacgatcgccgcggacacgtacagctggaagaacgcccgcgtcgacggcggcggcttcgtccccggcatcgtcttcaaccgctccgagaagaacctcgcctacgcccgcaccgacatcggcggcgcctaccgctgggccgagtcctcgaagacctggacgccgctgctcgactcggtcggctggagcgactgggggcacacgggtgtcgtgagcctcgcctccgactccgtcgacccgaacaaggtgtacgcggccgtcggcacgtacacgaacagctgggacccgggcaacggtgccgtgctcaggtccggcgaccggggcgcgagctggcagaagaccgacctgcccttcaagctgggcgggaacatgccgggccggggcatgggcgagcggctcgcggtcgacccgaacaggaacagcgtgctgtatctcggcgcgcccagcggcaaggggctgtggcggtcgacggactcgggggcctcctggtcgcaggtcaccgacttcccgaacgtcggcacctacgtgcaggacgcgaccgacacgagcgggtacgcgtccgacaaccagggcatcgtgtgggtcaccttcgacgagtcgacggggtcgccggggagctccacgcggacggtgtacgtcggggtcgccgacaaggacaactccgtctatcgctccacggacgcgggcgcgacctggtcccggctggccggccagcccaccggccatctcgcccacaagggcgtgctggacgcggcgaacggctgtctgtacctcgcgtacagcgacaagggcggaccgtacgacggcggcaagggacagctgtggcggtacacgacgaagaccgggacctggacgaacatcagcccggtcgcggaggccgacacctactacggcttcagcgggctgaccgtggaccggcagcatccggggacggtgatggcgactgcgtacagctcctggtggccggacacgcagctcttccgctccacggacagcggcggcacctggacgaaggcctgggactacacctcgtatccgagccgctcgaaccgcttcaccatggatgtctcgtcctcgccctggctcacctggggagcgaaccccgcaccgcccgagcagaccccgaaactcggctggatgaccgagtccctggagatcgacccgttcgactccgcgcgcatgatgtacggaacgggcgcgacggtctacggcacggacaacctgacgaactgggacagcggaagccagttcaccatcaagccgatggcgcggggcctggaggagacggccgtcaacgacctcgcctcgcctccctccggcggcgcccagctgttcagcgcgctcggtgacatcggcggcttccggcacacggacctcaccacggtgccgtcgctgatgtacacgtcgccgaacttcaccacgagcaccagcctcgactacgccgagaccgacccgggcacggtggtgcgggtcggcaatctcgactcgggtccgcatgtggcgttctcgacggacaacggcgccaactggttcgcgggggcggacccttcgggggtcagcgggggtgggacggtcgcggccgcgtccgacggcagtcgcttcgtgtggagcccggcgggcaccggggtgcagtacacgaccgggttcggcacctcgtggtcggcgtccgcgggcctcccggccggggcgatcgtcgagtccgaccgggtcgacccgaagaccttctacggcttcaagtccggcaggttctacgtcagttcggacggcggggcgaccttcacggcgtccgcggccacgggcctgccgagcggcgacagcgtgcgcttcaaggcgctgcccggcacgaagggcgacatctggctggcgggcggcgcgagcgacggcgcgtacgggctgtggcactcgacggacggcggcgcggccttcaccaagctcgccaccgtcgaccaggccgacaccatcggcttcggcaaggcggcgaccggcgcctcgtaccagacgctctacaccagcgcgaagatcggcggtgtgcgcggcatcttccggtcgaccgacaagggcgcgagctggacccgcgtcaacgacgatgcccaccagtggggttggacgggcgcggcgatcaccggtgaccccagggtctacgggcgcgtgtatgtgtcgacgaacgggcgcgggatcgtctacggcgacaccgcgggctcttcggacggcggcggtacggagccggcaccgacgggcgcctgcacggtgacatacaggatcacgaaccagtggtcgggcggcttccaggccgatgtacagctcgccaacaccgggtcgaccgcctgggacggctggtcgctgggctggtcgttcggtgacgggcaggaggtcacccagctgtggaacgcctcgtacgcgcaggccggttcgggggtgaccgcagcgaacctggcctggaacgggagggtggcggccgggtcctcggtgagcttcgggttcacgggaagctggtcgggatccaatggcagaccgaccgccttcaaactcggcggtcagaactgcacggtcgcctgatgcgaagccgcacgctcgcctgatccggagggcgcgggccgggccggcccgcgccctccgcctcctccacggcgtgtagaccgtggcctgggcaactcccgctgctggtgcaggcttccggcagtccgggctccggctgggtcgcgcgggcagtacccggcacgacgaaggccccgactgtcaccagtcggggccttggcgtttccggctagccgagcgaggccccgaagtccccgttctcggcttccttgccagacagttgcacggtccctcggtgagacacctcaaccttgtagaacctctcgcccttcggcacgtcaggcacggcgaccttgaacgtgcagtcgtaggtgtctccgtcgtaggtggagttgccgaggccgccagtggcgatgacatctccggatgcgccgtagacggtgacgccggcgccttcgaggatgtcgtcgtatccgcgggttccgccgcagccgccgttgccgtcggggacgacgctgtcagtgagggcgaagctgcctttcagcgtgaaggtggcgggcgcgtccggcccgctgttggcggtgatggcccaggtgccaccgacgatggctgctccggtggcgaggccgatgagtcctgcggcgagcgggctgaggcgtctcgccgcaggtgccggcggcacgtgagcggatacggcgggcggctcggtgggcgcgggcggcggggtgtcgggcagcggcggcagttcggatgtcaaggttccccccagggatgttcggagctgggatgttagcgccagatgatgttgaaatacatgggccggttgaagattcaccagttcgggaccggtgagacgtaccccccggcaacgtgccagccgggggctcgtgcggctggtcaggcagccggttgcggcaacttcagaaatccgtgggggaacggctcgtgttcgatgtcgcgtaggttcgggtcgcagaaccgactgaggaacccatccgaaatggatctccccaaattctccccagcgatattggatcatgagtttggcggccgtccgaacgggctggatggccgcctcctcgcctcactccgaaggctcgttcctccagttcagggcgtgtacaccgtgggcctgggggccgtcgccatgtcgtttccgaggaagaagctcgggtgcggtggctggttgtaggccgtgttctgccaggccagagctgtgcggtactgcgtgtcgtgcagcagggtcgtgatcttcgtgctcgtctcgtacggcgtggagtagatcctgagcgccgtgttgtcggtcgtcggccagacgacctcctcgcgccagtcgccgagaaggtcgcccgacagggacggggtggccttggtgctgttgtcggagtggacgcccgagccggtcagcaggcgggtgtcggacgcggtgccgtacttgtcgatgtgggtgtcgtcgaggagttcgcggacggtgtcgccgtcccaccaggacaggaagttgatgctgcccggcttgcggctcgccaccacggcgccctgcgggctgcggacaccgtcggcgcgggacgaccaggactcggcgccggcgctgcccgcccagacgtccccggacacgccccggccgttgtcgccgttggccgccgtcgaccacaggatcgcgccggtcccggcatcggccatccaggacgacggcttggaggagtcctcgtccaccttgaactcctcgaggccggcccgggaggggtccaggtcgccgacgtgcagggcgtcgccatggccgttcttcgtggtccacaggccggagccgttgtcgtccacggccatcgagccgtacacgatctcgtccttgccgtcggcgtcgacgtccgcgaccgacaactggtggttgccctggccgtcgtaccccttgccgctgttggtcgaggaggtggtgtcgaaggtccagcggcgggtgaaggcgccgccccgccagtcccaggccgcgaggaccgtccgggtgtagtagccgcgcgccatgatcagggacggccgggagccgtccaggtacgccgtccccgcgaggaaccggtcgacccggttgccgtacgagtcaccccaggaggagaccgtgccgcgggccgggacgtagtcgacggtgcccatcgccgcgccggtccggccgttgaacatggtcaggtactcggggcccgacagcacgtacccgctggcgttccggtagtcggcggacgagctgccgatcaccgtgccccggccgtccgtcgtcccgtcccccgtcttcatggcgacctcggccttgccgtcgccgtcgtagtcgtacacctggaactgggtgtagtgcgcgcccgagcggatgttgcggcccaggtcgacgcgccacagccgggtgccgtcgagtttgatgccgtcgacgacggtgttgccggtgtagccggactgggagttgtccttggcgttggtgggctgccacttgaggacgaagtcgagttgcccgtcgccgtcgaggtcgccgacggaggcgtcgttggcctcgtaggtgtaggcgacgccgtcgggggtggtgccgcccgcgggtggggtgaggggtacgtccttgtagcccgtacggaactggacggcgtgcaccgagtcggcctgctctacgccgcccacgatcgcgcggaccgtgtagtcggcctgggcgggcgccccggagtggaagtagttcgtggagccggtgatcggggtcgcgttgaccaacgcaccggcgcggtagacgttgaacgacacgtcgttctggtcggtgccgagccagcgccagctgaccaggttgccgctgtccgtgtggacgctgaccacgccccggtccagggcctcgacctggcgtgcggtggcggcctgggcgggtccggtggcgagcgtggtgagtccggcggcggtcaggacggcggctgccgtcatggtcaggatctgacgtctgcggttcctgtgcgagtgcgggtgctgcacgtgtgttacctcctgagaggacagacggttccgttccctcagttgccgctgcctgcccgggagttgccgcgtcgggcgaggagttcgccgctcacggcctccggagtgcccgcgggcggtccgggtccggcagtgcctcgctacgggcggcgagcgcgccgccgccggccgcgtggatcgcgccgaggcgcacacagcgggcgaggcggcgcggtgtccggccctgcccgtggccccggaagcgggccgagtacggcgttcgcggccgcctcggcccgcgcctcaccccgcgcgcgtggcgtcgtactcgtcggcttccctggcgtggtccagcccgtcgctcagctcgcgccgtgccccggcgcgaggtcctccacccggcgggcgagcgcgaagtcgagttcggtgaccgcaccgcccacactgtgggtgttcaccgtgagggagacggtgtggtagctgagggtgaggtcggagtggtggtcgagctcctcctggacctgggcgatgtgcacgaccatcgcggccgccgcgaagtgcgagccgagccggtaggagcgggagatccggtccccgtccagcgaccagccgggcagctccgccagccggtcctcgatctccttctgcgacaacggttcgacgggcatggcctcgctccattcgcacgacagcggctcttgcccagcctgccacagtcccgcgcgctcagcgccgtacgcactccgccgcgaagtcgtccgcgagggccgcgatctcggcgcggccctcgactcgctccagccactcgtgcggcagcccgtggtcgccgtacagcgcaccgaggaggttgccgcagatggcgccggtggagtcgctgtcgcccgagtggttcaccgacaggagcagggcgcgggtgacgtcggtcgtggcaagggcgcagtacaccgcgatggccagggcctcctccgcgatccagcccgcgccgagcgtctcgaccttctcgggggtcggatcgccctcggcggccaggtcgagggcgcggtgcagcgcggccgtggtctcgtcgtggccgggatgaacggcgagcagccgcagggcgcgcaggacggagccctccagggattcgccttctaccagatgggtgacgatcgcggcgagggcgcccgcggagtagtagccggtcggatggccgtgggtcgtctgggcgcagcgggcggcgagcccgaacgcgaagtcgacgggtgcccggccgagcccgaagggtgccgagcgcatgaccgcgccgcagcccttggactgcgggttgacggcgccgggcgggccgagggggagcatcgggtcggggacgtggtcctgggtgagcccggagaggcaggcgttgccgggggcgcggcgggcgtagagccagggccgggcggcgagtccgccgtcgacgtccgcgccgggtccgggcctggtctgggtgtccagccagcgtccgtacgcctggcggacgaggcggggcgcggcgccgccgatgcccttgtgccgttcgcggtggtgggcccgctggagtccctcgaccgtgaagagggtcatctgggtgtcgtcggtgatacggccgacgaccccgtcgccgtccgggacgagcccggtgatgccccgcggcccgtactcggcacgaatgcggtccagggaggcgaactcgacggggttgccgagggcgtcgccgatcgcgccgcccagcagacagccgcgtacccgggcccgatagcccgccgtggcctgccaggacagattccagcggtcgtacatgcacccctcctcgactacggtcctccgtatgaccattgtcgcgtccggcgccgtggcgcctccccccggcccgaccgagaagggcaccggcccgaccgacaggggcgtcggcccgctgctgcgcggctggcgggagcggcggcgggtcagtcagctggagctggcgctgcgggccggttcgtcggcccggcacatcagcttcgtcgagacgggccggtcgcggccgagcgaggagatggtgctgcggctcgccgagcacctggagatcccggtccgcgagcgcaacgcgctgctgctggccgccggatacgcaccgcactatccggagacgccgctggacgatccggcgatggacgcgctgcggcagggggtccggcggctgctcgaggggtacgagccgtatccggcgctggtggtggacgccacgtatgacgtcctggcggcgaaccgcggtatcgcgatgctcctggagggcgtcccggagtccctgctcacgccgccgctcaacgcgatgcggctgacgctgcaccccgagggtctggcgccgcgcatccgcaacctcggcgagtggcgcgggcacctgctggcgcagatggagcgccagatcgcgctgcaccgctcggcaccgctgcgcacgctgtacgaggaggtggcggcgtaccccgtccccgacccggtcccggacgcggccgacgagcccgccgaacccgctccgcacttcgcgctccccctgcgcatcgagcacgacggccgggtgctgtcgttcgtctcgtccatctccaccttcaacaccccgatggacgtgacggtggccgaactggccatcgagacgttcctgccggccgacccggcgacggtcaagtacctccagtcactacagccctgacagctcgccgtcgccggtcaggacggtggcgccgccgtcctgaccggcgcaactcccttgcgggcgaaggaaatcaagacacctcgaccccatgaaccttcccgcgggacatgtcacactgcacggatacttcggcgcgtggggaggcgtggcgtgagtgagcggcgggccgcgcccaccgtcggacaggtggtgctggggcggcggttgcaggagttgcgggaggcggccgggctgcggcgggaggaggccgcgcgggtgctgcgggtcgccccggcgaccgtgcgacgcatggagaccgccgaggtcgcgctcaaaatcccctacctccaggtgctgttggccacctacggggtgcccgacgccgaggtcgcggcctacgtctcgctggccgaggaggcgaaccggcccggctggtggcagcgctatcacgacgtcctgcccgactggttcagcatgcacgtcagcctggagggcgccgcgagcatcatccgctcgtacgagccgcacttcgtgcccgggctgctccagaccgaggactacgcgcgtgccgtgctggaggccgggaccgtcgggcagacgcgccccgaggacatcgagcggcatgtgtcgctgcgcatggcccggcagaagctcctcacccgggaacggccgccgcatctctgggtgctcatggaggagaccgtgctgcggcgtccggtgagcatccggggccaggtcatgcgcgaccagatcgaccggctgctcgaagccgccgagagcgacgacatcacgcttcaggtcctcgagtacgcggccggtccgcatccggggacgttcacgtcgttcgtgctgttccgtttcgcggagccggagctgcccgacatggtctacagcgagtatctgtccggcgctctctatctcgactcgcgcgccgaggtgtccctgcacctggaggtgctggaccacatggccgcccgcgccgcctccggccggcgcacccggcagatcctgcgcgagtaccgcgagcgcttctgaccgccggagctcctgacggccgatctcctgaccgccggacctcccgaccgccggagctcctgaccgccggacctcccgaccgccggagctcctgaccgccggacctcccgaccgcccgatctcccgaccacccgatctcccgaccgaccgccaggtctcccgaccgcggttcatccgaccgggatcatccgaccgccggtggccgtgcctcgtcggggagttgccgagccgcaggccgggacatgacgatgccgcgccctcctcggggaggacgcggcatcggcgtacgggcgtgtgtacgcgggtcaggcgagcttcgccgacagggtgatcgtcgtgccggtcagcgcctggctgaccgggcagttcttcttggcgtcctcggcggccgcgacgaaggcgtcgttgtcgaggcccggcaccgtgccctccacggtgaggtggatgccggtgatgccctcgccgggctggaaggtgacatcggccgaggtgacaagcttggtgggcggggtgccggcgccggccaggccgtgcgacagcgccatggagaagcagctggagtgggcggcggcgatcagctcctcggggctggtcttgccgttcgcctgctcggcgcgcgacggccacgacaccggctgctggccgatgccggaggagtcgaaggtgacgactccgttgccctcgagcaggttgccttcccagacggtgtgtgcggagcgcgtggttgccacggttcttcctttcgggtggggtcccgttgccgggaatccgtccccgccatccgatcacacctgggcccgcgacacccacccgacggggcggcgacctgccgaaccggccggtgaatcccctgccgaaggccccagggaagccttacagtccatgcatggtcgaactcttccaagtcctcgggggaatcgcgggatttggcggagtcgcactcggcgtcctgtatctgctctaccgggacttcgtgcgcgacatcatccgcaccagaatgttccggaccctcacctcggcacaggcgacggcgctgttcggtgccgtcatcgtgctcgccttcgccgtcgcgatcctcgggatcttcgccacgctggccgagagcaagggcatccagcagttcgtcgtgctcgtcgggatgctgctgttgttcctgctcgccgtggtggtcatcgcggcgcgggtggccaccggcccgcgggcgcgccgcccggcggccggggcgtcccgggccgaacggtcgctcaccacggtgcgccggcatgtgggcctcggcgagccggaccaggcggaacgcgccctggaggcctcgcacgtggaccaggagtcggaggagttctggtactggaaggcccggatcgcgctcgcccgctcgaacatcgaggtcgcttccggatatgtcgacgaggcgctgaggctcgaggcccgcaatccgcacagtctcgcgctgaagatcgcgctgctggtcctgggccgtgatccggaccggcgcgaccgggccgtccggctgtcggaggagagcaccgggctcggccccgaactcgacgcctggctgcggcggatgagggccgagggaatgttcgacggcggcgtgcacacccgcaccgagctggagagccggtgcccgctgcccgcccgtacgacggagagtgcacatgccgagtgacgagaaccagcagaacagccggcggaatgccggacggcccgcggtcctgtacgtcgggccgccggtcgccggggacgacgtggaccgggcggcggccgaggcacgggagcgggcgcgcggagcggggctggcgccgctggaggagttcgcgcggacggcggaggacgccgacgccttattggcggcccatcctgacgccgtgctcgtggtccatcccggtgacgcgccgcccgcgacgccttccgaaccgggcacggggctgtgggacttcttgcgctgtggcgccgtactgcgtctgtgcgggtccgaagccgcgggcgatgcggagcgggtgccgctgccgccgcgccgggagtgctgggcgttcctggtactcgacctcgtccggccggacaccaccacgggcgcgccgtacctccgggacccccggcgcgaggcggagtgccgggacttcgcggcgctgcacgctctctcggtcatggacgtcctcaccggcgatcgggcggtgtggacacggaccagcggtctcgcctccgtgctcctgccggtgaacgaggagacgctgaccgtcatcgtccacccggagatcaccgccccggacgcggacacccttgacggcctgctgtggcggtggctgcggcggggacggacgatccgctccgggcggccggtggaccggcatgccccggggatgcccagtgcccgggacatcacttccgagcccatgtacgagcggcgcctggccgccaatcccgacacggtggcggcgacaccagactccgtcggtctgctactaccgcgacctggaagcccccctttaagcccgcgcgtccgtgggaaaccgctgggggcacagcccggggcttcggagatgccctgccacccccaagcggccccttccccacacccccgcgacaaccacaccagcccctcccccacgacggcctctacaataccgccgcaacaacgccttcggcacccggtccgcgctcggtgtgagggacctcatcgagcagggcgtcatcatcgggcaggagcagatccggttcgacgacttcgtggcggaccgcaccgagcaggtgcccggcccccggcccggcgaggccgtcgccgtgagccatggactcgccgccgtaccgggcgagttcaaggcgaacgaggcgacgacccacttcgtcgagatcgcgctgaaggcgggccgcgcccgccccgaggacgctcccgccaccgagccgctccccgtgaacttcgtcttcgtcgtcgacaccagcggctcgatgacgggcaccaagctcgacacggtgaagtccgctctccagaccatctaccgcgagctgcgccccgccgattgcctgggcatcatcacgttcgaccacaatgtgcgcaccgtcctgccggccgtcgccaagcaggacctgccgcccgagcgcttcgcggaagtggtgtccgcgctgaccacccagggcgggaccgacatcgacctcggtgtgcagtacggcatcgacgagatcagccgccactccgtcagcggacgcaccgtcaactgtctctacctgttctcggacggcgacccgacatccggcgaacgggactggatcaaggtccgggcgaacgtcgccgccaaactgcggggcgacctcacgctgtcgtgcttcggtttcggctccgacgcccggatgcccgaactcgccgcgctcgcggggctggccggcggccactcgaccttcgtgacgcggcccgagcaggtcggcgcggatctgctgggcgatctgagcagacgtgaccacctggccgccatcgacatccagctgcggctcgacatcgaccccgaggtggagatccggcacctgtacgggcatgacctggtcaccgacccaagagcgcgcgccgcggtgctccgcgaggcggggcaggcggccgagcgggcgttgcaggactacggcaccaaggcgctgcccgacatcatcaccgaggacaagggcatcaggatcttcgcgcccgacctcgcgttcgaggagacgtactgggtcgtcctcgagatcagggtgccggcggggcgcgagctgtccgggctgggtacggcgaccgtgcagtacgtggacaccgtggcccgcgcgggacggcggcacgaactcgacctgtgcgaggcgctcacgctccccgaggagacggtgacggtgcacgcggtcggcctgtggaccagcgaggtcaccttctacgcgctggacgacctgtacgaccgcgacagggaggcggcgaagaaccggctgacgcaccacctcaagaacctggaggccgcacacagtcacctcccggccaaggagttccgcgacgaccaggtcaccctgcgcaagctgatcacgctcaccggagcactgggtgccgtggtctccttcagcgacgtctcccacggcgccggtgcgggtcccggcttcgcgcccgccgtgcgggtgatgaacgacttcggcagggtccggtcggggttctggccgcactactgacgctggccgctactgacgcggccccggccgtcgcggtcgccgcgcttcgcggtcagcgcacgtcgccgtcaccgcacttcgccgtcacctcacccggaagaccggcccccgtgcggtgaacggcagccgtgcgccctgcgggatgaggtacgcgtgctcgcgccggacccgcaggacgtcgcaccagccgtccgtgatcaccgggacgggcgcgccgggcgggaggtcgtccgcgcgatgcagcaggtcgatgccgggctggagcaccgtaccgccgcggccgtgcacccgcagccggccggcgatcaccgtgaccggcagatagcccgcgtcgtgcggtgccgcgtcgcagaagaaggtccacgtagtcgcggggactgcccagcggggcgccgaggatgtcacccgcgcccttgccgcgcagggtggacaggcggcgcatccagcgcaggtcgccggcgatgcggtcgtacacctcctccgcggacaggcccctcaactccggttcgcggagcagcccttcgggcatcgagccgatctgcatctcgcagagccagccgttgatgacgtagtcgcaggcgatgttgaacagcagcgggtcgcgggcgccgcagcgggcgcagtgcggcgtgcagcatctcgtgggcgaggatgaaccgccattcctcgtcgtcgaaccggcgcagcgggctgatgtagatctcggcggcctccgtgctcacggcggcgacggagatgccgtgggcgcgggcgagttcggcgtcggcgacgagggaccgaaggactccaggagcgcactcgccaagtccggagccgcaggattccgggtgcgtgatgtcggtgccggtggcaccggcccgccccgaccggacggccctacgccgcgcgctcgtcggcccgcgtcgccaggggcacctgcgggccgtcgcactcgcgcagccagcggcggaagacccggtggaggtgctcggcgccgaccagttcggtgccgtcgtccaccggcgccgagaacgcgaccggcgagagcaggaagggacgcccctgcgcgccgccgagcccgccgtgcgaaccgatctgctcctcgaaggcgaggacttcgccctcgaccgggtcgtaccaggagttgaccatgatgtcggcggtgtgcgggaaggagtgcgtgcgccgtacggcgtcggcggcgccggggccgaagtcggcgagcgggccggggtgttcgtcgtcgagcgcgtcgacgggtatctcggcgccgtgcgccccgagcaccagcccgccgtgctcgtcgctccgtacgaggacgaaacctatgccgggatggttggcgagggtggacagcagcgccgggtggcgccggtcgatctcctccttgctcatccggtgcggcacgtcggggaaggagacgagcccgaggttgccggaggcgagcacgaccggctcggagcggcggtgcgacgggcggtgttcctcgccgccctcctcgaccggccgccgcagcgcggcgcgcaccgccgcccgcgcctcggccccgctgtgggtgcgccgggccctgcgcggcacgggcagcccgcagccggcccggaccagattgccgagggagaggccgtagcgggtctggaaggtctcgccggggctctggccgtggtcggagaggacgacgacgcggtacggccgcggggcgtgctcggcgactttggcgatcagcgcgagcgaacggtcgaggcgctccaggaccttcgcggcgtcccggctgcgcggcccggagtggtgcgcgacctcgtcgtacccgaccaggtccgcgtagaccgcgttgcggccggcgagcatgtcgccgatcaccgcggcgacgacgacgtcccgctcgacgacggtcgcgaaggcgcggatgaacgggtagaggccgccgcgcttgacccggggccgctgtttccgcacgcgcgccagggtggactggcccatctcccggccgacctcggcgacgagggacatggcggtgcggacggcgttggcggggtcgcagaagtaggcgaagtagcccgcccgggagcggttcttcctcccccgccgcgcggcgatggacaggacgagcgcgagctggtcggcgccgccgctgaagaggttgccgcggctggcgccgtcgacggtgaggagaccgccgtcaccggtgcgctcgacggcgcggcgctggagctcggcggcgctggaggggcggttgcagaccatgacctcgtgggtttccttctcgtaccaacggaaggccgggatgtcgtggttggagccgtgcaggatgcctagctggctggcgccggtctggctggaccagtcggtgcgccagggggtgagcacatgggtggggccacggccgccgcgggtgccggcggtggggaggccgagccaggcggcgacggtcggcatgagccccttggccgtcgcctccgccaggacgtcgtggccgacaccgtcgagctggaggaagacggtgcccggggtggagggacccgcctgcccctcgccgcgtctgcggcggcggtcggcgagccggtacagcctgcggcggtacgcgtcgtcgtcccgtaccgcgagggcaccgccggtggcggaggccacggcggacatcacggcggcgaccacgacggcggtctcgggcgcggcctcgccccggccggaggggttgatgcgcagggcgatcagcagcagggagccgttgaggaagaagacgagcaggccgatgacgagggcgggcacgaggagcagcaggcgcacgagcaggggccagaaaagggacgacagcagaccgaagacgcccgcgccggcggccgcggtgatggctatccgggtggcgctgtcaccgttgtcggactggagctggaagtcggggagcagtccggcgaggacgagcatggtgaccgtcgagacggcccatacggcgatactccgccacaccccgctgagcacactccgccaacgcccgccacccacgccgcacccacctcgcgtcccggcccacacctgtacgggccttctccaccctgtcacaacgcatgggggatcccgggtgtcaccggatgctctccccccggccatcctgctccgccgcaagggcgcgcaagcgtgcgaccacgacggcggtgggtccacccacaggggtcagcggccgtcgtaccccgctgtcggcatcgaaaggcgccggtggatacgggccttcatcttcgcgtcgtacgacggttccgcgcggcccaccgtctccacgcggacgccgcggcgggcgcactccgcggcgaactcgtccacggaggcgagcgcgcgctccaggacacggtggctgggggcgacgaacaggtcgacgaggccggcctcgacgtcggcccacagggcgcagtggtcgggccgcagtccgcggacgaggagttcccgggtcacgacgtagccgcgctcggcggcccagcgggcgcacatcgcgtactggctgcgggagtcgacgaggaaggggtccgcgtccagttcctccaggggcgtcaggctggcgatggccgtgacccgtaccgtggccgacgggccgaaggcgccgcgcacgtctcccatggtgtcccccctcacctccgggtttcgccgccgaccctactcctgcccgtaggctcggggggagtcgcgcgaaggaggcaaagggagtgccggtggagatcacctggtgggggcatgccacctgcacggtcgaggactcgggaacgcgcgttctcaccgacccgctcttcgcgcgccgcctggcgcacctgcggcgccgccggggcgcaccgcccccgcccgaggcggcggtcgcggacgtggcgctcgtctcgcatctgcacgccgaccacctccacgtaccgtccctggcccggctcgcccccggcacccggctgctgctgccgcggggcgccgtgcgtcaggtgccggggctgcgcaggctcggtcatctgcggctcaccgaggtcgcgcccggcgatcggacgcaggtcggtgacctggtcgtacggaccgttccggcgcggcacgacggacggcggctgccggtcggtccgcaccgctcgcccgcgctcgggttcgtgatcgagggtgccgcgcggacgtacttcgcgggggacaccgggctgttcgaggagatggccgaggaggtcgggcccgtcgacgtggcgctgttgccggtcggcggctgggggccgtatctcggcgaggggcacctggacgcggggcgggccgcgcaggcgctcgcgcggctgacgccccgcagcgcggtaccggtgcactacggcacgtactggccgatcgggatggatgccgtgcgcccccatgaattccacacgccgggcgccgagttcgtgcgcctcgcggcggagcgcgcgccggcggtcgcggtgcacctgctggcgcacggcgagagcgtacgcccggaggtggcccggtgagacgcccggtccgcagaccgcacaccaccgtgacggaggccgcccggtgatattcctggccgcggtgaactcgaccgtgtcaccggcgtccacgcagcaggccatcggctatccgacgctgttcctgctggtgctgatcggcgcgctggtgccggtggtgccgacgggcgccctggtcagctccgcggcggtggtggccttccatcagtcggcgcccttcgcgctgctgttcgtcttcgcggtggcggcgctcgccgcgttcctcggcgacatcgcgctgtactggctgggccggcgcggaatgcgctccaagaacgggtcgcgctggctgcgggcgatccgcgaccgcgcgcccgaggaccggctcgcacaggcgcaggagaagctgcgcgaccacgacatcgcggtgctcacgctgtcccggctggtcccggcgggccgtctcccggtgatgctcgcctgtctgatggcggacatgccgctgcggcgcttcgcccgcggcaacggcccggcgtgcctcgcctgggcggtgacgtaccagctgatcggcatcctcggcggttccctgttcgaggagccgtgggagggcgtggtggcggcggtcgcgctgacgctgacgatcagcgtcgcgccgagcgtgtggcgcaggctgcgcagggacgccgcctagctctacgtcctgtccggcggatcatgatgccggaggaaggcggcggagccttgtcagcccgggtgcgccggggcatgaaccgccggacaggctctgggcccggagatcactccaggacccgggaggcccccaccggcaggtcccacaggtcctcgcgggccagccccgccttctcccaggccgcccgcacccgggtgagcggctccaggaccggctccgcggacaggacgaacgtcgcccagtgcatcggcgccatccggtgcgcgccgaggtcgaccgccgcctgtaccgcctcctccggatcgcagtgcacgtcgctcagccaccagcgcgggtcgtacgcgccgatcggcagcagcgccaggtcgataccggggtagcggcggccgatctgcgcgaaccagtgcccgtatcccgtgtccccagcgaagtacacgcgctgcccgtcgggcgccgtgagcacccaaccgccccacagggtgcggcaggtgtcggtcaggctgcgtttggaccagtgatgggaaggcacgaagtccaagcggacaccgcccagttcggccgcctcccaccagtccagctcggtcacctgcgtgaagcggcggcgccggaaccagcgggcgagtccggcgggcacgaacaccggggtgtcgcgcgggagtctgcgcagggtgggggcgtccaggtggtcgtagtggttgtggctgatgacgaccgcgtcgatgcgcggcagggcgctccaggccaccccgacgggggtgatccgggcgggtgtgccgaggatgcggcgggaccagaccgggtcggtgaggacggtgaggccaccgatccggaccacccaactcgcgtgccccgcccaggagacggcgaccatgcgcgcgtccacccggggcagcggcgccggctcgaagggcagcttcgggatgtcggcgagtccctcgggtcccggccgtatcgcgccctcgcgggcgaaccgggctaaggccttgagtccgggcagcggggcggtcagccggtcggcgaaggagcgctgccatcgccggcgctcgccgagcggacgcggctcgggcggtgcgttcggcggtgcgaggggcccggcgggggtgggcggggacggggacggggacgtgaatgtggtcgtggtcgtggtcgtcgacgtcggctcgtcggcgtcctggtccgtcggcgaaacggtgctcgtggtgaacccggactgcttcgtctgcttcgtctgcttcgtctgctccgtctgctccgtctgctgcgtctgctgcgtcatcgaggaggctcccatcgctgagcgtcgtcgcgaagatcgtcgaagaccgatcccagaaggatcaacgcgcgttgcacgtgtggcagttccaaaggcgcgggtgaatcgaggcaccgcgtccgctcctcggcggtggtgccgaggagcggcccggtggacagccgtacgcgcagggccgcgaggtcgtccccgaagcgctggccgccgggcgcgggcaggccgagccgggcggtgaggaagtcctccagttcctgtgcgtcgcccactccgtgcgcgctgagcgcggagcgcagcgggccgaggtccacgtacagatgccggccggcctgcgggggccgggcgagggcgcccgcggtgaccaccgcacggtgcgcggcggtggccacgcgcgcgtgcaggcgtacggcggcggtgaggcgttcggtgacgtcggcgggctcgtcgagcgcgtacgcggcggccgcggcgaccggtcgggcgatccgggcgccgagcgcggtgaggacgtcgaggacacgggcgcgcagcccggcgccgtcggcggtgtccgggaagcgggcgacggccgcgggccagccggccggcaggaaggggccggcgaggtcggtcaggacggtgaccccgtcggggagcatctcggcggggctgaacagcacggtgtcgtgcgggcggtgcacggtgtcgcgccaggtctcgtcgctgaccaggtgcagtccctcgcccgcggcggcctcgatggtctcgtgcagcacctcgggcgggtgcgacggttggcggttggggttcgttcggccgacccggcgacggaaccgaaggaccccccgggattcccccggccttcgggcacggaaccctgcgaccggttcttccaggagggggggtccggaatcccgggaaggcccccccaatttcccccggggggttcgccaacaagggaacaccggacccttcccaggcggccccgggcccttgggggtgcccaccaggcggcgcagggccggggcacgagcacatcgccaccgagcgccgcggtcagtgcgaggagcagggccggggcgcccggtgcggcggcgacgcggtcggggcccgcggacagaccgcgccgcccgaagtagccgcaggccgcggcgaggagggcggggccgccgccggcgggttcggcgtcggggcggtccgcggcggcggcgagggcggccgcgagtcccggcagtacgggcagtccctggtcgggcagcggcgggccgtagcggacggggccgtgtccttcccgatccgtccgccgcatgggtgcctccgcgcagtctcgtacgtccgttccccatacggtctcggccgtgccctcggcctctccgtacccagggttccgtcctgccatgggcgcccggccgggttgcgcccgtcacagcgtcagatgcgggaggacgttcccttccggcgcagcactcggtagcaggcggcgccgatggcgaccgcgaccaggacgctgccggtgaccagggcggggatcgacccggtgaaggcgccgccctcgccggcctgcgctccgcgctggaccccgggaggcgcatccgccgcaccggacggattcacggcgtcggggccgttcggcgtgtcggggggatcgacggcgtcggggcgattcaccgcgtcgggcggctcgaccgtgccggggcggctcgcggtgccgggcggagccaacgtgccggggggatccaccgcggcgggcgcatccagcgtgtcgggcgggaccaccacaccgggcggcaccaccgcactggggggattcacctcgtcaggacggttcaccgcgtcgggcgcgtccgccgcgtcggggcgattcaccgcaccgggatccaccgtgtcgggcggaaccaccgcacccggaggatccaccgcggcgggcgcatccagcgtgtcgggcggagccaccgcgctgggaggattcacctcgtcaggacgattcaccgcgtcgggcgcgtccgcagcgtcgggcgcgtccgcagcgccgggcacgtccgcagcgccggacggatccgccgcgccgttgcgggcctcgccgtcgcgggtgtcgctgggcaaggcggtccactgactctcctggccgcccgtcgtcacggggcactgtccgtcgacctcccactgcgccggggggccggccgcaccggtagcaccgccgtcgaagtccccgtcggacggcatacgcgccgtctcgccgtcggcggccgccccggcgtcgtcgttccctccgagccgcagctgggcctcggtctcctcggagctctgcgggccggcctcgatggcgtcggaccgctccgcgccggtggcgtcgcaggagacggagagggtgacggcgccgccgggcgcgacggagcgcggtctgacctccgtggccggatccgcggacgcggccggggcggcgacgcccagggcggcaccggccagggcggtggcggacaggacacgggcgcaacggcgcatgggctgggctccttcggcgggctctgcgggggcacggcggtcgtgcccccgcagcccatgacagcccgcccggcggccgcacgcgcgcggccgggcaccattcgcgctacgtacgccgccgggcgggtgacaatgccggaccactgcggagcctgcggtcggcggtacggcgtctgcggtcggcgccctgggagagccctgggagagccggcgcagggctccgaaggccgcgtccgaccccgccgaggccacccggaacgcggcgccggtgggtgagccgcttctccatggcgaaggcgagggcgagggcacggcgagggacatgatgtcccgtcacctcgccctcgccctcgccctcgctctcagccggacgaacctgaacctcggctcaggcggcgtcccgcatcacctgctcgcgcagtcggtcgcagcagcggctgatgatccgtgacacatgcatctgggagatgccgagctgctcggcgatgcggctctgcgtcatgtcaccgaagaacctcatgtagaggatgtcccgttcgcgctcgggcagcgcctggaggcgcggcttgacggcctcgcggtcgacgacgatgtccagggccgggtcggccgagccgagggcgtcgctgagcgagtacccgtcctcgctgccgggcagttcggcgtcgagggagagcgccgtgaagctctccagggcctccaggcccgcccggacgtcctcctcgctcatgttggcgtgctcggcgatctcggcgacggtgggcctgcggcccgagatggtctgcgagaggtcctgactggcgaaccgcacacggttgcgcagatcctggacgcggcgcggcacgtgcagggtccacatgtggtcgcggaagtggcgcttgatctcgccggtgatcgtgggcacggcgtagctctcgaaggcgttgccgagctcggggtcgtaccggtcgacggccttgaccaggccgagcgacgcgacctggcgcaggtcttcgtagttctcgccgcggttccgaaagcgtccggcgagccgttcggccatgggcagccaggcctcgacgatctcctcacggagtgtgtcgcgctgctggcccggcgggagcgtggcgagcttgcggaaggcctctgcggtgtcgggtgcatcgtcgtgcgagtggcgcttcgcgctggcttgggttcgcatggtgcgtcgcaactcccttgaggggtgcctggggtggacggtcaccgtgggagcgcacccggacacgggaccggacacacccgtggtgagggtttcccgctcccacggacgtgcctcctgtccgaagcactgtcagaccgcctgcccctgatcatgcgaggcaaaccacccgcacagcctccgggtgaaaaccgttgccgcccccggttcaggagcgacggcagggccacgcggcggacgctccgcacgggtccgcccgatcccgtgtcgacctcgtcccaccgggtacgcggtgctcacccgagctcaccccgaaaggatctggagcgaaacatgcagcgaggcagtgaccggctgagcgtccaccgggacgacgagatgaaacacgaactgcagggtctgctgcggtccggtcacccgacgcgggccgaagagtggaacgacccggaaccgacggccgacgacgacccgcagatcgcgggcggccctgtgacgcccggcggcgccacgggctcgctggccgccgtgcgctacgagctgggccggcatctgggacgcacctcgttccccgcggggcccgccgatctgatcggcgccctgcgccgcagccacgcccccgacgcgctcgtcgaaccgctggagcggctgccgcacaaggcccgctacaccaacgcgcacgagcttgccgaggcggtcgtacggaccgccgacggcgccgggccgcaggacgaggaacaggggtaacacgggtaacaggcgaactggaggaacaggagccggacgcccagcgaacaggttcgcgggtaccgcgggccacagcgggagatcacagaagggaccacttccatggctgatttcgtcagggaggtcatgactcccggcgtcgtcgcggtccgccccgacgcatcgctcgtcgaggccgcgcagctcatgcgggcccaggatgtgggcgatgtcctcgtgaccctcgaccagcagctcgtcggcgtgctcacggaccgtgacatagcgctgcgtgccgtcgcggacggcgtcgacccgcgcaccgtgagcgcccagggcgtgtgcacgaccaacccggtggtgatcggccccgacgagcccgtgtcggccgcggtcgcgctgatgcgggagcacaccgtgcgccgacttccggtcgtcgaggacggacacccggtgggcatggtgagtctcggcgatctggcggtcgcgcaggaccccgaatcggtgctcgccgacatcagccgcgccgaaccggacagctggccgggcgcggctcccgcggcacgctgagggccggccggcaggctgagaaaggacagtgaacagtcatgcgcatcgcattcctgaccgcccccgagggggtcgagcagatcgaactcaccgacccctggcaggcggcggtcgacgccgggcaccaaccggtcctggtctcgaccgagcccggacaggtccaggcgttcaaccatctcgacaaggcggacaccttccccgtcgaggaggtggccggtgaggtgccggccgactccttcggcgcgctggtcctgcccggcggggtggccaaccccgacgcactgcggatggacgagcgggcggtggctttcgtccgcgccttcttcgaccagggccgtccggtcgccgcgatctgccacgccccgtggacgctgatcgaggccggcgtggtcccgggccgtgtgctgacctcgtggccgagtctgcggacggacatccgcaacgcgggcggcacctgggtcgacgagcaggtgcagatctgcgaccaggggcccaacacgctgatcaccagccgcaagccggacgacctgaaggcgttccgcgaggcgtttctgaccgagttcgacaaggctgcggccgcgtagcggctcagccggacgtcccgaagccggtgctcggtccggaccagctggtccggaccgagcaccggcttcacgtgcgccgaccgcacgggggccggacggtcgacgcggacacctcggtcagctcggacgcctcacgcgccctgagcacctcacgcggctcgggcagacctcacgcgagtcacgactggaggctcgtcacgcctgggcgcatccccgctcccgggctccctcacgagtgcggcccggggccaccgggcggcgtggatggcggcgcagatactcgccctccagctgcgccatgcggacgttgtgcacccgcagcgcgtcgttggaaccgtgcagcagcgtgtcgtgacgcgtgcggtggatcgcctccagctccttcatgagttgctggtcggtcaggcggcccgggtcgactccgttcatgatcgtgccccgatcgtcgtgtccctggtgcggtccgggtacgcgctcgggacctaccacccgagggcatccaggagggaccatggatctcgcctctctccatccactctacgaacatccggggccctgggcctccgcatacgccgacacgccccggcgcaccagggccacgcctacgggcgctccccgacggcgcgggccgcgcgcgttccgctacctggcccgctccacccggcgctcgtcccacaccggctccgccgtctcccgtacgcggccgtcggagccgaagacgagatagcggtcgaaggaccgggcgaaccagcggtcgtgcgtgaccgacaggaccgtgccgtcgaaggcctccaggccctcctggagggcctccgccgactccaggtccaggttgtcggtcggctcgtccagcagcagcgcggtcacgccctccagctccagcaggaggatctggaatcgggcctgctgtccgccggacaaccgctcgaaccgctgctcggcctgggcggtcagctcgtagcgccgcagccgggacatggccgcgccgcggtcctgggagtgctcgccccacaggatgtccagcagcgtgcggccctccagctccgggtgggcgtgggtctgcgcgaagtgcccgggcacgacacgcgcgcccagcttccactcccccgtgtgcgtgacgtcgtcgcccgcgagcaggcgcaggaagtgcgacttgccggagccgttggagccgaggacggcgacccgctcgccgtagaagacctccaggtcgaagggtttcatcagcccggtgagctcgagccccttgcaggtgaccgcccgtaccccggtacggccgcccttgagccgcatggtgatgtcctgctcgcgcggcggctcgggcggcggtcccgcctcctcgaacttccgcagcctggtctgcgcggcctggtagcgggacgccagctcatggctgatggaggccgcctgccgaagattcagcacgagcttcttcagctgggcgtgcttctcgtcccagcgcctgcgcaactcctcgaagcgcgcgaaacgttcccgccgcgcctcgtgatatgtcgcgaaaccgccgccgtgcacccaggcgtccgccccggtggggctcggttcgacgctcacgatcttctccgcggcgcgggcgagcagctcacggtcgtgggagacgaagagaacggtcttgcgggtctccttgagccgctcctccagccagcgcttgccgggtacgtcgagatagttgtcgggctcgtcgagcagcagcacctcgtcggtgccgcgcagcagcgcttcgagcacgagccgcttctgctcgccaccggagagggtgcgcacctgtcgccactgcgccttctcgtacggcactccgagcgcggccatggtgcacatgtcccagagcgtctccgcctcgtacccgcggacctcggcccagtcggagagcgcctgcgcgtaccggagctgggcggcctcgtcgtcgacggtcatcatggcgtgctcggcggtgtccacggcgcgcgccgcttcctggatgcggggcgacgcgacggacacgagcagttcccgtacggtcgtctcgtcccgcacggaccccacgaactgccgcatcaccccgagtccgccgcccaccgtgaccccgccaccgtgcggcttcagctcaccggagatcagccgcagcagggtggtcttcccggccccgttgggcccgacgagggcgacgacggccccttctcccacccggaacgacacatcgccgagcagcaccctcccgtcgggaaggtagtactcgagatgcgcggcttccagatgtcccatggcgcgcattgtcctgggaatcgcctgccccgggcaaactcgtttcgtgtccgcggccgcctccgcccgggccggcacgcagtaatcccgccgccctgggtacgtgccccccatgaccccagatgtcgacctgacggtccgccccccgcgcccccgcgtcctgcgagaccgactgctcgccgccgactaccgcctcttcgagaaggtcgccgcccggcactggccggggggcgaccgcctgctgcccaggctgagccgcaccgcgaaccacggggtcctgtggttcgccgcggccaccgccctcgcggccaccggcagcccccgtgcccgccgggccgccgcccggggcctcgcctcgctcaccctggcctccgccacgatcaacaccctcggcaagcgctcggtccgccgcccgcgccccgttctcgacccggtcccgcacgtccgccgcctcaagcgccagccgatcaccacgtcgttcccgtcgggccactccgcctcggccgccgccttcgcgacgggcgtcgccctggagtcacgcggcctgggcgcggcgctcgcaccgctcgccgccgccgtcgccctctcgcgcgtctacacgggcgtccacttcccgagcgacgtcctggcgggcgcggccctgggcgtgggcgccgcgttcgccgtccgcgggctcgtgccgacccgcgaccggctcccgccgccgggccgcccgcgcgtggacgcgcccgcgctgcccgacggcgcgggtctggtggtcgtggccgaccagggcgcggcggccccggaccgcgtccgcgccctcggggacgccctcccccgtgccgagacggtgcagtgcgaaccggacgaggtgcgggccgagttggagaaggccgccgcccgcgcccaggtgctcggggtgtgcggggacgacggcacggtgaacgccgccgccgaggtggccctgcgtcacggcctcccgctcgccgtgctgccgggcggctcacccgaccacctcgcgcacgacctcggcatcgagggcgtacgtgacctgacccgcgccctgcggcagggcgacgccgtgcgcgtggacgtcggccgcttcacctccggggacatcgagcgctgcttcctcggctccgtcggtctcggcgtccatccggagctggtacgcgagcgggaacgctgggcggagtggctcggcgcctggccggccgacgtgatcgccgcgctgcgggtgctgcgcgcggaccatcaccccttgcaggtcggactggggggtgcgccccgcccgctgtggctgctgttcgcgggcaacggcacgcaccaccgcacggggctcgcgcccggccgccgccacgagctcgcggacgggctcctcgacgtacgcgtcgtgcacggcggccgccgccccgccgcccgcctgctggccgcggccctcgccggtccgctcacccggtcccccgcccacgcggcggtccgggtacgggaactgcgcctgaccggtgtcgcgcccggcaccctcctcgcccacgacggcgaagtcaccgaagtccagggcgatgtgacgctccggaagcttccggaggcgctgacggtctaccgtccgttcccccgcacctgaccgcgagatcggtggtccatatggcaagacgcgggtctcatcattcgacattcgcacgtaccgtgatgcctgtcgccccgcggtgaggctccgcggggcgcgtacgacgcgcaaccgacgcgaaggggaacggtcatgtcgaagtcgcaggagaccgccgtctacacccacggccatcacgagtccgtgctgcgctcgcacacctggcgcacagcggccaactcggcggcgtatctcctcgactcgctgaagccccacatgaagatcctcgacatcggctgcggtccgggcaccatcaccgccgacctggcggcgctggtcccggacggccgggtgaccggggtcgaccacgcaccggacatcctggagcaggccagggccacggccgccgggcgcggtctgcgcaacgtcgagttcgcggtcgcggacgtgcacgcgctggagtacccggacgacaccttctgcgtggtgcacgcacaccaggtgctgcaacacgtgggcgatccggtgcaggcgctgcgcgagatgcgccgggtcaccaggccgggcggtttcatcgccgtccgcgatgcggactacgcggccatgacctggtatcccgagtcaccgggcatgaccgactggctggacctgtaccggcgcgtcgcccgggccaacggcggtgagccggacgcggggcgccggctcagggcgtgggcgctgcgggcgggcctgacggacatcaccgccacgtcgagcacctggaccttcgccaccgcggaggagcgggactggtggagcggcctgtgggcggaccgcaccctcgcctcggcgtacgcggcccgcgccacggagggcggccacgcgaccacgcgccagctgcgggcggtgtcgcaggcgtggcgggagtgggggcggcaggaggacggctggttctccgtcctgcacggagagattctctgccgcaagatcgtctagagcagcgatccggctagagcagcgatccgagcggtccgaggtccagattcaggtcctcgggccgcacaccgtagcgctcgcacagttccttcatgcggtcgtcgagcagcatcagcgtgagcccgatccgctcttcctggtcctccgtcagctctcccgtgtcgaagcggcgcaccgcctgccgctccatcagctgccgcagcagttccacgacggtcagcacgagcttgacgagatcgcgctccacggtgtcgggctcgagatccagccgattacgtccactgctgcttgtgctcactgttcctcctggtccggccacggcgaggggacctgggcgttcaccgagctgatgagcgcgttcagatcgatgcgcacgagatcgacgtccgcgatgcgcagggtgaggtcgccggtgatgacgacgccgccggcgagcagccggtcgagcaggtccaccagggcgatctcacggcgttccaccacggtcacgcgtccgcctccccgtcgatgccgctgaacgagtacgcagcccaggggccggtgagttccacccgtaccccggacagttcgtccttcgtacggtccactttctccacgaactcctccgagtccgaacgcggcaccagataggccgcgttgagcacgttgcgtcccgacgcccgggagagcgccggattctgcggggcgtgcagacgcgaatcctcggcgtattccgcgagggtgtggtgcagccggcccgcgaagcgctcgctgttctcccacatctcctcgtgggaccgattgcgctgacgccgctgacgcagatagtcccgtcccgaggccgctttcccgggcgaacgttccggttccgtctgctccgtttcggcgtacaccttgacgccccactccacgcgcccgtccaggcggtccagcgtgcggcggaaggcctcctcgcgcgcctccatcatgacccgtacggagctgtcgtcctggaacacggtgccgagcctgagcggcaggggcgtcgtgaccacggtgagcgcgtcgatcacactttggtgggcgcgggcggtcgcggtcagccactccaggtcctccagatgggcccgcagcggctcctcggcgaagtcctccgccggcacctcgctgacgacggcgaccagaccgtggtgcgagagctgcttgggcggggcgcccgccacccccgtcagctcggcctggaggggcgtgccgaaggggcggcagacggcgtacacgtaacgcagcccggtcatgaggcctcctcttgggggcgggcgccctccagttcggcgacatgggcgcgcaactcggcgttctcccgggcgagttcgttgtgccgggcgcgcgaggacagtgccgggtcgtcctcccaccagtcgatgcccatctccttggccttgtcgacggaggcgacgatgagccgcagcttgatggtgatcagctcgatgtcgagcaggttgatgcggatgtcgcccgcgatcacgacgcccttgtcgagcacccgttcaaggatgtcggcgaggttggcgccgccgcctgagccgtaggggtcgggcagtctgctgggagtggtcatcggcgacccccgcctaccggggcctcttcctcttcgtactcgtactcctcctcaggagcctcgtcctccgggacctcgtcctcgtcggcgtactcgccctccggagcttcgtcctcgtcggcgtattcggcctgctcctcgtacggctcgccttcttcgccgtccgcttcgccgtcctcctggtcctcgtaggcctcctcgggctcttcggactcgccctcagggcccgactcctcggcctcctcctcggcgaccgcgtcctcgtgactgcggacgacctcgccgtcgcggatctcgccgcgccagccgtcctcggcctcgcccttgagcgtgatgaagcgggcgaagttcttgaggtcgagccgggcccggcggccctgggcgcgccagatgttgccggtcttctcgaacaggcccttggggtagtactcgatgacgagcagcacccgggtgaggttgtcggccagggagtggaaagtgacgacgcccttggtcgtgcccttcgcgccctcggacgtccaggagatccgttcgtcggccacctgctcggtggtgtgcgccttccagctgcggttggaccagaagaccttgagctgccagtcgctcgtcgtgtcgtcggcgcggttcgcgctcttgacgcccttggcgaaggtgctgaagtcctggtactgggtccactggtcgtacgccgtgcgcagcggcacgccgacgtcgatgaactcgatgatgacggtgggcttcttgcccgcaccgcccttgcgccggcccttgccgccggtcaggttcttcaaggcgcccacgacactgtccttggcccggccggcgccgagttccagggcggaacgcagcgggcccttgccctcggcgagtttgcggccgccgtcgagcgcgagcttggcgaagcccgggctgttgccttccgcgatgtcgttgagcttgcccgtggtctcaccgagcttgcggccgaaaccgaccagcagccgctgggcctgggcgcccaggtactcctgcacctccgccttgagccggtcggcggcctcgctctggacgacgccggtgatcgggttctccttcaccccgcccttcgcctggtccttcgcccggcccgtcacggacccgagggtgtcactcatcgtcgccgcccctttcccgggtacgagtccgggtgacccggcgcgcggaactcttggcggccgccgtcctcttggcggccgccgtcctcttggcgggagccttcttggccgccttcttcgccccggccgttcccgccgccgtcttcgtcgccggagccttcttggccggagccttcttggccgggcccttcttcgcggcggtcttcttggccggcgccgcccggcgcgggcggtcctcctcgccgtcgggctcccggtcccgctcttccggctcgtccgcctcgccccgctcgtcccgtgcgtcctcctcgtcccgctcgtcctcctcctcgtcgtcatcgaggcccggcacgtccggcgcgacgcccgcgagctggtcgcgcacttgcgcggtccgcccgtgcagccggtcggcgagtccttcgatctgccgctcgagcagcgctccggaggcggccttgccgacgccgcgcagatcctgccgcagctcgtcgccgatctccttgaactgcgggttgttcagcagctgctgggagaccaggtcggcgagggcccgcggggtgaggttcagccgcttgccggccaccatggtgccgacggcgaacgccagcttcatcttcttggtacgtccgaggacgtatccggcccctatcgcgaggcccagtcctattcgattcatcctgtcgtcccgttgccggttcccgcgccgctgcgcgagctggtctccagccggtcgaggagctcgtcctcccggcggtcgaattcggtctcgtcgatctcgcccgcctcgagctgctgctcgaggcgggcgagttcggcacggatcgtggccgggtcgtagtactggcgctctgcctccgccagtacctgacccagcacccagatgctgccccgcgccggtgcgaacggcagcagcagcacctctgtgatcaggcccatgccatcagctcccggtgggcggccgccggtgcccggcgggtcactcgacccgctcggcgccggtgaagctgtccaccgactcggacgggtcgggttcgacgaagctgtacggcggcagcggcccgttgagccgcacgtccaggtgcggatggcccttgcgcagctgctcgacggcggcgacgaaggtgtcggcggcgtcgcgtgccaccaggaacgacacgttggccagccagcccgtcgactcggggccgacgctcaccgcgtcggccgcgggctccagcgtgtgccgcacgtccaccgcgtcctcggcctcgcgccgctggacggccgccgcgaccatctcaccgagttgcaggcgatggtcgtaactgccgccgcccgactgacggttggcctcggcgagcgcccgtatctcggtgttctcggacatcacgcggtgcaggacggcctcttcgtcgtggctcgccttgacgttgtactcgacccggccggccagtgccgtcaggcgctccttgtagtggtcggcccgctcggcgagcacaccggcgacggccgcgtcgtccgccccgacgctgccgaagcgcatgggcagcacggtgccgccgcctccggcctcgttcaggacgttctgatgggcgagcagatccctgcgcttggggcgcagcccctcgggcgcgtcgctgacgatcgccgccagctcgccctccttgatgatgcgcaccggcatcggcggttcgccgaccccgcccatgccgtcggggagcgaggggtgggaactcgcggcgatgccgtagacgtacgtactcactcctgctcctccttccggcgcgaggcggtggacttgcgggcgcggggccggctctcgctctgcccctcctcacgggactgcttgaacgcgtcggagatcgtctcggcggcgccggacagcgcccccttggacttgccgcgggcgccggactcggtgatgtcaccgaccaggtcgggcagccccgggctcttgtgcggtccggattccaggtcgagccggttgcacgcctcggcgaagcgcagataggtgtcgacactggcgacgaccacacggacgtcgatcttgagaatttcgattccgacgagggagaccctcacgaaggcgtcgatgacgagccctcggtcgagtacgagctccagaacgtcatacagcccactggagccacctccgccaccggtctgctgtgcggggacaacggtcatgcgggttgaacctccctggtccgtcaaatgggttgagcgtggggcggggacgcggtctagcgggcgtcggcccggccgcgttcgtagcggcggacccggcgatagccggtgagttcgccgtacgggtcgagcttcacctcgtagctggccagcaggctcatcgtgtccgggacacgggcgagttcgagaacctcgacctgcaactgccagccgtcctccgagcgttcgaaggacgagaccgactcggcctccaggccggtgagttcggcgaactgggcgcctgccttgcgtagcacctccatcgtgcccggccgcttttccgccgtgccgccccgctcatttctcggtgcgtcctgcgtattctgtgaatcttgtgattttgacgtgttggatgtgttcgacatggccacctcccccttcgaatggccacaaaggcgagggccaaacctccaacactgcgcaacagtccgtgggtcaaccgcgcaatgcgcggaaccggcgcccccgagggggcgccgggcagggctcggaccgttaaggcccgggcacgacgacgtgcggtccgcgcgaagccgccgtcatcagcacggacggcagcttcggaaggtcagcgcacgacggcctgttccaccagcagccgggccgcggtggcgatcgactcggcgtcgatgcccgcggcgtgcaactgctcggccggggacgccgagccgggcatcgtacggacggcgaggcgcaccaggcggggcacggggcgtccgtcgaggaaggcgtcgaggaccgcgtcaccgatgccgccctcctcgcggtggtcctcgacggtgaggaggcagccggtgtcctcggcggcctggcgcagggtgtcgcggtcgaccggcttgaccgagtagaggtcgatcacccgggcccggatgcccgcctcggccagcgagtcggcggcggccagcgcctcgtggacggtgacgccggccgcgacgagcgtcagccggtcctcgccggaggaccgcagcaccttgctgccgccgaccgggaactcctcgtcgggcccgtacaggacgggcgacgcgccgcgcgaggtccgcagatagcggacgccgtcgaggccggccatcgcggcgacgagcttcgccgtctggttggcgtcgcaggggtagaggacggtcgagtcgtacaccgaccggaacatcgcgaggtcctccagtcccatctgcgagggcccgtcctggccgatggacacgccggcgtgcgagccgacgaggttgatgcccgcaccgctgatcgacgccatgcgcacgaagtcatgggcgcgggtgaggaacgcggcgaaggtcgcggcgtacggcacccagccgcgggcggcgagtccgacggcggcggcgaccatctgctgctcggcgatgtagcactcgaagtagcggtcgggatactccttggcgaagtactcggagcgggtggagtcgccgacctcgccgtcgatggcgacgacgtcctcgcgggcgccgccgagcgcggtgagcgcctgcccgtaggcgtcgcgggtggctacctcgtcacccttgtcgtagcgcgggagctccacctgtcccggcgcggccacggcgtgcaacacccgtgccgccgggggatcttggacctcgatgcgcagctcgcggacgccgccgagttcggcgatcgcctcctcggcgtccggcagcggtttgccgtgcaggccctcgcggtcctcgacggccgcgacgcccttgcccttgagggtgcgggcgaggatgacggtgggctggccgctggtggactcggcctcgccgtacgcacggtcgacggcgtccacgtcgtgaccgtcgatctcgatggtgtgccagccgaaggcctggaaccggcgggcgtaggcgtccaggtcgtgtccgtgccgggtggggccgcgctggccgaggcggttgacgtcgacgatcgcggtgaggttgtcgaggtgctcgtacccggcgtgctcggcggcctcccacacggagccctcggcgagttcgctgtcgccgcacagcacccagacacggtaaccggtgcgctcgagccgctttccggacagcgcgatgccgacgccgacgggcagaccctggccgagcgagccggtggccgtctcgacccagggcagccggcggggcgtggggtgcccttcgaggcggctgccgagctcgcggaaggtgagcagttcggcgtcgtcgatggcgccggccgccttgtaggcggcgtacagcagcggcgaggcatgtcccttggaaaggatgaagcggtcgttgccggggtgggcgggacggtcgaagtcgtagcggaggtggtgggcgaggagtacggccatcaggtccgcggcggacatcgaggaggtggggtgcccggagctcgcggcgtccgcggcacggacactgtcgacccgcaactgctgtcccagttcggtgagttgacgggtgttcatgagggtccttccgtagtgggggtgtcagtggtggcgagcctctccggggcgccgggcatccgtgccagttccggcgacgcggtgtccaggggcaccgaccaggaccgcaccagacccaactgcacggcctggcgcggcagtacggcctccagcagccagtcggcggcgacgcggacacggttgccgggcatggcggcgaggtggtagccgcgggtgacggcaccggcgagcgggccggacagggggatgccgagggggttggcggcggcctgcaccccgccgaggtccacgacgaagcccaggtcgcggtggcggtaggggcggcgggtgccgatgccgaacgaggcggccacgttgtggccggcggtcttcccctgccgccaggcgtgctgggcggtcatcggggtgtactggcccggattctccaggtcgggtacggcggccgcgtcgccgcaggcgaacacctcggggtggccggggacctggagggtcggctcgacgagcagccggccgctctccatcggcagtccgagggactcggcgagcgggtcgggccgcaccccgacgcaccatacgagggtgcgggtgtcgacgaactcgccgtcggacagcaggactccgtcggacgtcgcctccttcacggaggtccccatgcgcacctcgacgccccgcttgcgcagcacgcggtcggcggtgcgcgagagccgttcgtccagtccgggcaggacccggggtgcgacgtcgagcagcagccagcgtggccgcctgccctcgcgcagcggccggttgcgcaccagcgcgtcggtgagcagctgcccctgtacggcgacctcggttccggtgtaaccggcgccgaccaccacgaaggtgcaccgggaggcgcaggtctcggagtcggccgccgcggcggcgagttccacctggcgggtcacgtggtcgcgcagatacagcgcctcgggcagtccccggaagccgtgtgcgtgctcggcgacgccgggaatgggcagcagcttgttgacactgccggcggcgagcaccagccggtcgtacgtcagtgtgccgacgtcgccctccgggccggtgtagcgcacggtgcgagcgtcgaggtcgatgccgtccgtctgggcctcgccgagcaccagccgcacgtggggcagtgtgccggcgagggagacggtgacgcggcgcggctccaggatgccggcggcgacctggggcagcaggggcagatacagaaagtagtccgtcgggttcaggagagtgatgtcggccttgtgccgggtcagccgggaaagggtgcgggccgtctggtatccggcgaagccggcaccgacgatcaggatgcggggtcgactcacgattcgcctccggcgggttcgctcgtacggactttccgcgtcccctgggaggggtcacccaaacccgacggccccgcgcgtttcccccctccggcggggatatccggccgggaaaccgacccgcccccgtcgcggaggtgccgcccctgcccgagtacggccacgtcctgcggatctcgccaccacctcccgtaagacgacgcgcgggaccgccgtcggcccccgtcatcgcgacggccccgcgacgcccggaccgagccggcccccgtcaggagcccgctcggcggccccggtggtgcggtgcttcggggtccatgtcgtcctgacgcggcgcacccggctccgcggttcccggcatcggcgcgccgggcgcgaccggcggcaccggcgggtacggcatgccgaggccgcccggcggcccggcgggcggggtgcccccgacgacccggccatggtcgcctgccggttcgaggtcgtacctggtcgtgggccgggacggcgacggccgcgccgcggcgcgcagcagctgggcgacgacaccgagcacggcggcggtgatcagggcggccgcccagcccggcaggccgagcgacagcgccaggccgagggcgaccgccagcgcggcacccgcgtagagggcggcggcgcccgaagcggcgtagagcgtggccgtgcggcgctgcttgcgactctgctcgcgcagctcgtcgcggatggtctcgcgggcgacctgcgccagctcgtcgaccaggctcttgtccagatgttccaggtgatcgagaggcttcatgcggcccgggtacccgggcctccgctcccgtaactccgcgcgtgacgccgtacgcacggcgaagcgccggacccggagccggcggaacatccggccggggcgggggatcggtccgaagcgatctcctcccccgccggtcccaactaggctctgcggtatggagattctgggagccacgctgcgtatctgcgtcgacgacctggaggcttcggtcccgttctacgagagactggcgggcggcagcgcgctgcgtttcgagcgcggtggcgtccaggtcgccgcggtcggctgcttcctgctgatgagcgggccggaggccgaactcgacgtcctgcgcaaggtcgcggccacgatcgcggtgaaggacgtcgacgaggcccaccgagtgctcggcgactcgggcgcccacatcctggcggggccggtggccacgccggtgggccgcaatctgatcgcgatgcacccggacggctcggtgtacgagtacgtggaccggcgggcagcggactgagtcctcggccccgtggcccggccgggtccggtgcgcgggtccggtgtccgggtccggtgtccgggtccgccgtccggtcaggacgcgtcgaacgcggacacgacgatgtcggccagcagcgccccggccgtcccgtccgggtccaggtcggggtcgtagatggtgacgttgagaccggcgcagtgcggggagcgcagcaacggccgcagcagcgcgacgacctcgtcgggcagcagcccgtccgggtcggggctgtcgacggcgggcatgacggacggatcgaggacgtccgcgtccaagtgcacccagaacccctggagttgcggtatctcgaaggcctccaccgtggcccgggcgagcgcgtccgcaccccatgcgcgaaggtcgccgacggtgacggtcgcgatcttcagcgcgccgagttccgtccgctccggatcgtcgtcgcggatgccgaagagccgtacgtcctcgtcccgcagatacggccgcagcccctcgatgtcggtcaggtcctcctgcccccgcccggtggccagcgccagttcctcgccgcccgcggcgccgacgcggtccgagttgccggggtggcggaagtccgcggaggcgtccaccgcggccagcccgtaccgcccgatgcggcgcagtgcgagcgaggcgccgagctggatggagcagtcgccgccgaggacgaccggcagatcaccggcgcgtacatggtgttcgatgcggtcggccagcttgcgggtgtacgaggcgagggcggccgcgttgaagacgccgtcgccctcctgccactccccgcggtcgtagcgcggcggtacgacgacgccgccctccaaggcgcccaggcgctgcacgatgcgctgttcccgcagcgcgccggcgagcttgtagcagccgggcacggtgcccggggcgggcgggcgcaggcccaggttggagggggcgtccaggacgacgatgcttcgcatgggttcatcctcgccgaagggcaagctcagcgagggccggtcgccgtgatcgcccagcgctcgtggtcccgccaggctccgtcgatgtacaggaagtccggcgagaacccctcgagccggaagccgcagcggcgggcgagggcgatggaggcggcgttgcccggctgcgcgttgatctccagccggtgcagccccagggtggtgaacgcgtgggcgacgacgagtgcgagcccctcgcccatcagcccgcgcccggcggcatgcgcgaagacgccgtatccgagtgtcccgttcagaaaggagcccgcgacgatgttgttgatgttgatgaacccggcgataccgccgccgtccttctcgcacaccaggaagccggccttcgtcgggtcctcgatgagccgacccgcgtaggcgtggtacgcgtccgggctgtcgggcggaaacagccacggccggtgcaggtccttgctctcccgcacccgggcgaggaactcggcttcgtcgtcgtaggtgaagggccgcaggcccacgcgggggccctcggcgagatagcgggagttctcagacaccccgacacagtacgacggacggcgcgtgccagggccttttgacgacaggacctagcggagcgcgggttcgtccagtgtcaacgttcccgcgtccgcgtccagttcggcccgtacgccgaacgggatcgtcagcgctccctcgcagtgcccgaacccgaactcctccacgaccggcaccccgagtccgccgagccggtcggcgaagaccgcgcgcagcttctcgtagggaccgcacctctcccacgacccgagcgcgatcccggcgaccccgtcgaaccagccggcgcgcaggagctgcgtgagcgaccggtcgatccggtacgccgcctcgccgacgtcctcgagcatcagcagcccgtcccgggccccggcacgggcgtgcggggtaccgaggtcggtggccagcaggctcagacagccgcccagggtgacgccccgggcccggccgggaaccagcgctgggccgccggacgcgatggtgcgcacggactccggctcgaacagcgtggcccgcagatgttcctgggcccgcgcgttcttgatgaagtcggcgcccgccgccgcgggcccgtgcagcgtgacgaggcccgcccgggtggcgaacgcctcgtgcagcgcggtgatgtcgctgaacccgacgaacaccttgggcccggcggcccgcatcgcgtcccagtcgagcaggtcgaccatccgctgcaccccgtacccgccgcgggcgcacagcaccgcgtccacgtccggggcgcaccaggcggactggaggtcggcggcccggtcggcgtcggtgcccgccaggtagtcgaaccggggatgccggtcgaggacatgcggggtcgggacggggtcgaggtcccagccccgcaggatgtcgaggcccgcctgaatccgttcctcggggaccgggccgctcggcgcgatcacggcgacacgggcgccgggggccaggcgggcgggacggttcagcggggtcgtcgacatcacgtggtgagctccagggtcgggacaccgggcggattcagcccgaagacctgcgcgtacagggagagctccgattcaagcacccgcaccgtcgtgtcggcccggcggaacccgtgcccctccccctcgaaggcgagatacgcgtgcggcaccccccgcccccgcatccgcgccaggaaccgctcgcactgcgccggcggacagatcacgtcgtccagcccctggagcagcaggaacggcgcggtgatccggtcggcgtgctccgcgggcgaccgctcggcatagcgccccggcacctgggcgagcggccccaccagcgactccaggtactgcgactcgaagtcatgggtctcccccgagccccagccggcgaggtcgaggatcggatagaggatcgtgccgcagccgtacacctcggtgctcgccagggacgcggccgtcgtccagccgcccgcgctgcccccgcggatggcgagccgggcgcggtccgcggtgccctcctcggcgaggccgagcgcgacggccgcgcagtcctcgacgtcgacgacgccccactgctcacgcagccggttgcggtactcccgcccgtgcccggtcgatccgccgtagttgacctcggcgaccccgatgccgcgcgaggtgaagtaggcgatctccaggtcgaggacgaggggcgcccggctggtggggccgccgtgcgcccagatgacgtagggcggcagctcgtcgccgggcgcgacgcacccggggttgtgcggagggtagatgtgcgcgtggatctcgcgccccaccggcccggtgaacgtgcggatctgcggctcggggtagcacgcggggtcgaccgggtcgtcgtgcgcggcgccgatcacccgggcgcgggcgacgggggttgcccctgctcgatcggagccgagagcttgggggagggtgtccagctcgaccacctcgtaggcgctgcgcgggctggcgccgatgccgacgacccgggtgccgtgcacggcgagcgtggcggcgaactcggtccaggggccggcggcgtcgaccacctcgccggtctccgggtcgaggatgccgagcgcggtggcgccccgcccgtgcaccacggcgatcagtccgctctccagcggggcgaaccagcgctgcccgatcttccacagcgggccgccgaactcctcctcgcgggggcacaccggctcgtcgtcgcggtacaggttccaccagccggtgcggtcgctggcgtacagcagggacccgtcatgggcccagtccacctgggcgatcgactcgtcggggccgccggcgaccgtgtgggcctcccgcagcgtcccgtcaccggcgacctccgcgacgatcagctccgtgccgtcccacggcatccgcgggtggtcccaggcgagccaggccgcgcgccgcccgtcgggcgagagccggggcccggtgacgaaccggtgccgcccgtcggtgagttcccgcacggcgccccggtcctcggccgccgaaccgtccagcggcaccgcggccaccacgcggcgtacgtccgtgggcccgtcgccggtgaactcctccagcacgcaccacacttcgccgcgttcgacacgcagccgcgggtcgacccagcgcagtccgccgccgaccggggaaacgggcgtgagggggcgcggccgcgcaccgggggtatcgggctcgtgggcgtagagccgctggtcggcgaagtcgacgaacacgaccagcggtccctcggggcgggccgcccccgcccaggggcggccgccgtactcgatgacccggctgcgcacgttccacggcgcggacaggacggactcctccacgccgtccgccctgcggcgtacgagggtgcgccggccgccctcggtgggccgcggctcggtccaccaggcctcgtccccgacgaagcccacgaactcgggctgcccgtcgtgcgcggccgcgagccccgccgcgatgggcgagggccatgaaccgtacgccagggtctgcatcctgtcccccgtcctaggcggtgcgaagaaagcggtcgagcacgcggacgccgaagtgcagggcctcgacggggacgcgctcgtccacgccgtggaagagggcctggtagtcgaagccctccgggagcttcagcggcgcgaacccgtatccggtgatgccgagacgcgagaactgcttggcgtccgtgccgcccgacatgcagtagggcacgacatgtccctcgggtgcgaactcctcgacggcggcccgcatcctcgcgtacgtcaccgagtccaccggcgcctggagggccacctcgcggtgctcgaactcccactccacgtccggcccggtgagccggtcgagggtcgtgcggaactcgtcctcaccgccgggcagatagcggccgtcgacatacccgacggcctcccccggaatcacgttgatcttgtaaccggcgctcagcatggtcgggttggcgctgccccggacggtcggctcgacgagcgcggcggccgggccgagcttcttcagcaggccgtccatgtcgtccatgtcgtcgaggtcgtcgagatcggcgtcgatgccgtagaccgccgcgagttcggtgagcgcagcgcgcaccgtcggcgtgagccgcagcggccacgcgtgtgcgccgatacgcgcgacggcggcggcgaggcgggtgaccgcgttgctccggttcaccttggagccgtggcccgcccggccgtgggcggtgagcttgagccagccggtgccacgctcgcccgccgcgatcggatagagctgtcggccggcgccgtcgtggaaggtgaacgcccccgactcgctgatgccttcggtgcagccctcgaagagcccggggtgccggtcggcgaggaagccggagccgtccacggcgctcgcctcctcgtcggcggtgaaggcgatcacgaggtcgcgccggggtcgcacgccttcgcgcgcccagtcccgtacgaccgcgaggatcatcgcgtccatgttcttcatgtcgaccgcgccccggccccagaccacgccgtcgcggatctccccggagaacggatgcacgctccagtccgcggcctgcgcgggcaccacgtcgaggtgaccgtgcacgaggagggcgtcggcgagggggtcggtgccctcgatgcgcgccacgacgttcgtacggccctcggtgcgctccagcagcgtgggctcgagacccgcctcggccagcttctgagccacgtactcggcggcgggccgctcgcggcagtccccgccgccgcggttggtcgtgtcgatgcggatgaggtcggaggtgaaccgtacgacctcttcgagtgccggtgcttcagccatactgctcctcgacggcggccgagacgatcgtggtgaccgccttgaaggtgcggatcccctcgtacatggtcccgctggtgtacgacaccttccgctctccgatgcgccccacacccggcacgacggtggcggccatcgcgaggtgctcggcgtcgaactcgagcgccacggtgaacggcccgcccacgacgggttcgtgcggcacggccagcgaggccgcctccttggccgcggcacggatgtcggcggcggtcctggacggcgtacggcacacggccgcgtagcgcgagacatggtccttgacggcgaccttgagcgcctcgggcgcgtatccgagcgcgtcctcgcaggccacgtcgtcgcccgtgacgaggacgaccggcaccccgtactcggcgacgacgtgggagttgagcagtccttcgctggcccgctcgtcgttcacccacacgccggtgatggagttggcgaggtaggtgtgcgcgaggacgccctccatgccggcgcccgcgtggtagccgatgaacgcgatgccgtccacgtctccgtgctgtacgccctccaccatggacaacgacttgtggcggccggtgagcatctccgcccgctcgtcaagccgttcgagcaggagattgcgcatcgaccagtgtgcctcgttgatgagcacgtcgtcggcgccgccgtcgaagaagccgagcacggccgcgttcacgtcggaggtgaacatcgaccggcaccgctcccactgcggggtcccgggcagcacatcggccggccaggtcacacccgtggcgccctccatgtcggcgctgatcaggatcttcataccgcgtcacgctacgcgctgacgaacccccgggccaggacccgcgtcgccgggtgtggaggcggcgttactcgtccgcccgcggcccggcgtcccgctgccggtcaggccccacgccctgccagcagccacctggacggcagttcgatgcgcgtgccgtcgggccggtactcggtggtgacgaggggcagctcgccgctcgcgagaaccgtgagacctgcggcgtcgaggtaggcggggaccgcggcgtccgccacctcgccgggggcgatgccgtgccggaagacgggtgcgagcttgggcggcggtccttgggggctccgcgccaggcccttcagcaccactcccgcggcctcggcgagttcgacgaggaagagccggccgcggtcgcccagcagggtcgcgatgccgtcgacgagcggctgccggtcgtcgggctcgcactggtggagcacgccccgcatatatatgttggcgtcgcccagttcggcgtgcagggtctcggcctcggtcttctcggccgcgtccagcagccggtacgtggcctggcccgcggggtcggcacgacgggcgtggtcgagggccgcggccgacagatcggcgcccacgacgtgcgggaaacggtcggccaggaagcgggtctgggtgccgttgccgcagcccaggtcgacgaggggcaggcccggggccgtcaaccgcggctcgaacagtgccagatggacgcccgcggtcagtatgggctccgcgtcccagaagacggccccctgtccttcgggggcctcgcgccagaagccctcccaggcctcccggtacctactcgtcacgctcatgcccagctccccggggtgcgaccgcaacccgtcggacctgacgggtcagatcggtctaccgcgcagggcgcgcggccacaagcacgtgacgcattccgttaccgcccgttcggtccgcgtacaccgatcacggcggctcagcgtctcggcagtgtcagttcgaaccacaccgtcttgcccgcgctcgtacggctggccccccattcccgggccagtgtgctgaccacccgcagaccccgcccgaactcgtcggcaggtcccgcgccgcgcagcgacggcagcgtgtggtcctcgtcatcgacctcgcacagcagggtctcgccgcgcaccagacgcagctcgacccgacggctgcgggcatggcgtacggcattggtgaccagctcgccgaccatcaactcggcgttgtccgccaggctgttcagtccccattcgtgcagttgctcacgcaccgccgcacgcgcccggcccacctcgacggggtcgagggcgaagcgccacagggcgacgtcctcgggggcgatgccgcccagccgggccatcagcagcgccacgtcgtccttgcgtccgccccggacgttgagggcgcggatgatggtgtcgcaggcgtcgtccatggaggcggcggggtgggcggcggactcgcagagggtggcgagacccaccccgatgtcctcgccgcgcacctcgaccaggccgtcggtgcacatcaccagccggtccccgggcgccacgggcacgcgtaccgactcgaacggcaccccgccgacgccgatgggcgcacccgtcggcaggtcgagcagttcgctgcggccgtcctcggcgcggaccagcaccgggggtatgtggcccgcgttggcgatctccagctcgctcgtgatcgggtcgtagaccgcgtacagacaggtcgcgaggtaggtgtcgccgagccgctgggcgaggtcgtcgaggttgcgcagcagctgggcgggcggcaggtcgagcgccgccatggtctgtacggccgtacgcaactggcccatcatcgcggcggagttcaggccgtgacccatgacgtcgccgacgaccagggcggtgcgggagccgggcagtttcaccgagtcgaaccagtcaccgccgacccgtcccagcaacgtgcccggcagatagcgggtcgcgatgtcgcagccggccatgcggggcgcgatgtgcggcagcatgctgtcctggagggtctcggcgacgctctcctggtaggtgtacatgcgcgcgttgtcgagcacgaggcccgcgcgggcggcgagttcggcgccggtgacccggtccatgtcgttgaactcgacgcgctccggatgccgcagcaggatcatgaagccgagcaccacgttgcgggccttcaggggcacgaccagcatggagcggttgttgatgagcggccggatgtcgcgcttctcgaactgcgcggcgatggcgtgccccatctgctcgctgatgcgcggcacgagaacgggctgcccgctggtcatgcactggaagaacggcgtgtgcgccgggaacggcatggcctcgccgaccggtacgacgtcgtcccagcggcccggttcgtcggtgtgctcgacggcgacccggtgccacatcgtggtggtgtcgggcacgccgtcggggaagccctcgccggcgacgacctgttcgcgcagataggtgcccgcgacgtccgtgaagcgcggtacgacggccttgctgacctcgatgatggtctgcgccagatcgagcgaggtgccgatgcgtccgctgacctcgttgaggaactccaggcgttcgcgtacggcgacgtactcgaggtcctcgccctcgtcctggacgtcctgcggcacgctctcgcccgacgccaccgccctggcggcccgctcgcgacgcgccttgcgctccgcccgccggggcacaccccagtcgggagtgacgggcacccggtcgttctgactgaactccagtacgggataacccagttcgagaacctgcgagacgatgcgcgcgctctcgccgacgctcatgctgggcaggatctcgggcagttcgcgggccagctcctcggcgccggggaagtcggtgtgcagggcgaagccgggcgcgatgcgctcgacggcgacgccctcggcaccccgggcgtcggggcgcagcgcgtccgcgtcggcggccagcaccagcagccgctcggggcccgggcccaccagggggtacgcccaccacagcacgtcgatgcggtcacgctccggcacccggagccgggcccggccggcggccgggtaggagagccatccgccgagggaggactccaggtcggggcccaacccttcatacgccgcgtacgcaccgtacggcgcgatctcgtcgtcggggagcgccccggagacggggagcaggtcgacggcgggacggcccaccgcgtcctccctcgatgtgccgaacagccggcgtgcgcccctgctccagtgcgagaccaggcccgcacggtcgacgacgaccacggcgagggggatacgcccggccgcggtggcccgctccaccgcgccgtgcccagctccgtggccggaaggtgcgccccactcggtgccacgttccatggcccaggccctctctccccacggctccgcaagatctgtgccgccctcaccacggtacggcggcggtcggtcgcgatgtgtggcaatacgggaatttgagtctccgggggcggctccggcgtacgacacggtccgcacgcgctccggtcccgccggggagagccgtccggcgggtcagtcctcgtgtcccggtcgggtcagtcctcgtgccccaactgcaagtcgcgttccgtcctgccgcccccggcgacctggagcacggtggccaccggcggatagcccgccgcgatgaccgtgtactcccccgacgagagatcgacgaaccggaacgttccgtcaccgcccgtggtgagcgtgtcgacgacgttgcccgccgcgtccagcagcgtcacccgcgcgtcctcgacgggccgcccacccccggcccgtaccgtgccccgcagcaccgcaccgccggccagttccacgtcctgccgggtctcacgcgcggcctgcacggtgacggggagcgcggccggacggaacgcgggggcgctggcggccagggtgtactccccggccaccaactcggtgatgacgtagcccccttcgcgtccgctgcgggtggtggagaccacctcgccgtggacgttggtgagggtcacgatggcctcgcgcacgggggtgccgtccgccgtgagcacgctcccggcgagcctgcccgcgccgccgagcacgacgtccagttccaccggacgctcgccgacggtcaccgacacggcctgcggctggtggccgcccgccgcggcgatcaggacgtacgaccctgatccgggcgtggacagcgcgtaccgtccgtcctcgccgctggccccccgtccgatctgctgccccgcgacgtcgatgagggtgagcgcggcgcgcggcacgacggtgccgtcggggtgctgcacggtgccgcagacgggcacaccggcggcgtacggcgaacgcgcctgcgggacctgggcgagggagacgggctcggcgggggcgttgtgggacaccagtggtttctccttgagaaagaaagcgatgagcaggcccaggacgagcaccggcacgaggaagaggaagatgcgcggcatggcgtcggcgtaggcggcgacatagccgtcgcgcaggtccgggggaagcgcgtggacgagttgcggggtgagggactcggggtcgggaagccgggcgcccgcgcgcgtgggaaggcgttcctccagcgcgtcggcgagccgatgggcgaacagtgtgccgaacacggcggcgccgacgctgccgccgatctgccggaagtagttgttggcgctggtcgcggtgcccaggtcggcggggcgcaccgagttctgcacggcgaggaccaggaccggcatcaccatgccgatgccggcgccgaggacggccatccagatgctgtactggagccggggcgtgtccgcttcgagccgggagagcagccacatgccgacggcggccaggacgctgccgaggatcggccacatccggtaccggccggtgtggctgatgagctgcccggcgatgatcgaggcgccgacgatccccgccatcatgggcagcatcagcagtccggactcggtggccgaggcgccgtcgaccatctggaggaaggtcggcagatagctggccgcgccgaacagcgcgacaccgatgacgagtccgacgagcccggtgacgttgaagacggagtccctgaacagccgcagggggatgaggggttcgggcgcgaagtgctcgacgaccaggaagaggacggccgcgacgcacgcgcccgcgccgagccccaggatgatccgcgagtcccacgcgtactcggtgccgccccaactggtgagcagtaccgcgcaggtggacgccacggccagcagcagcgccccgagaacgtcgaggcgcgccttggtgaggggcttgggcagtttcagcgcgacggtgacgacggccagggtgaccaggccgaagggcgcgttgatgtagaagcaccaccgccaggagaggtggtccgtgaaatagccgccgagaaggggcccggcgacggaggcgagaccgaaggcggcgccgatcaggcccatgaagcggccgcgttcgcgtggcgggacgatgtccgcgatgatcgcctggacgccgatcatgagtccgccggcgccgaggccctggatcgcgcggaaggcgatcagctgatccatggtccgcgcccggccggcgagcacggagccgacgacgaagacgacgatcgcgaactggaagacgcccttgcggccgaagagatcgccgcactttccgtagacgggcagtgcgacggtggcggtgagcagatacgcggtgatcgcccaggacatcctgtccagaccgtgcagctcgccgacgatcttcgggagcgcggtggccacgatcatctgctcgagggcggcgagcagcatggcgagcatgagggcgcagaagaccaaccgcacccggcgcgggccgagttgcgcgggcccgggcgccggtggggcgggggtgtccgagggctcggcggccggctcgtccttgaccagagtggtcccgcccacgtctcgctccccatcgtcgcgctcgccgcacaattgccgctttccgcgacaactacgagcaagcgcgacgagttacggcgtactaccgcaggaccgggagatccactcgaaacggtgagggtggcaacgcgccccggatgattgcctcttgggctacttctccatcgcggcggcgaggttggcgagttccgcgtcgtagatccgggcgaggcccttgggcgcgaaggtcctctcgaagaagccgccgatgccgccggcgccgttccacacgctggtgacgacgacgcgggacttgccctcgccggccggggtgacccgccaggtggtgaccatcgaggagttgcggtccttctcgacgagctcgccgtcggtcggctcggtcacctcgaggaggcagtcgcggacgcgcttgctggtggcctggagcttccagtggacgagggtgccctcgccgtcgccgccctcgcgcacctcgtactcgctgaagtgctccggcagcaccttcgcgcgggcgtcgctgtagtcggcgagggcgtcgaacaccttctccgcgtccgccgcgatgatccgctccgtcgtggcttcgacctgcgccattgcgttcctccagcacctggattctcggggttgacggtcagccaaccaccccgtggcccggccgcccaaatcggggtgcccctcagccaccgaaaggcgaggtcgcacgatcaagggaacatgtgttctattctgtggtcagtgctaccgaggaggcgtcatgcgctgggagaacctcacagcgggccccgccggggaccccgcccgagacgccgcgctgttcggcgcggacgcggtgaccacccgtaccttcgacaccccggagttccgcggcatcaccttccacgagatccgggcccgctcgatcgtgaaccgggtgccgggggcctcgcgcatgccgttcgagtggacggtgaacccctatcgaggctgcacacacgcgtgcgtgtactgcttcgcccgcaagacgcacagctatctggacctcgacacgggtctcggcttcgactcgcagatcgtggtcaagatcaacgcgccggacctgctgcgccgccagctcgcctcacgccgctggcacggggagcacgtcgcgatgggcaccaatgtcgactgctaccagcgggccgagggccgctaccagctcatgcccggcatcatcgcggccctgcgcgaccacgcgaaccccttctcgatcctcaccaagggcacgctgatcctgcgcgacctcgacctcctcgagcaggccgccgaggtcaccgacgtcggcatctccgtgtccgtcggcttcaccgaccacgagctgtggcgcaccgtcgaaccgggcaccccggccccggagcgccgcctggacgtcgtgcgcaccctgagcgagcacggcatcggctgcggcgtcctgatggccccggtcatccccttcctgagcgatcaaccggcccaactccgcgccaccgtacgggcgatcgccgccgccggggccacctccgtcacgcccctggtgctgcatctgcggcccggcgcccgggagtggttcatggcctggctcgagcaccatcacccgtacctcgtgcgccgctacgagcgcctgtacgcggagggcgcgtacgcccccaagtggtaccagcgccggatcacccgtcaggtccacgaactggcccaggagtacggcatcggccccacgcgcgcggggatgccgcgccggatacccgaacccgaacccgagacgccgccgacgcccgagccgacgcagctcacgctgctctgagggcatccgagcgcatcccgctacccaattgggtcaagtctcgacagaacacgttcttccgggcgccgtttccgggacgatgcggcgagggccgtgacacccgcggtccgacaccctgcgtcctgggaggcctcgcttgagaaaacgcgcagccgtgctgtgcggtgccgccgtgatggtggccgggatgctcaccaccgcacctgccgacgcgagtgctccacgcaccgcgcggaccgcatccgccgcgaagctcacctggaagaagtgcggcaccgccgactttccgaaactgcagtgcacgtccctgaaggtgccgctcgaccacgcgcacccgggcgggcggaagatcacgctcgccctgtcccgggtcccgcacaccgcgaagacgtaccagggcccgctgctggtcaaccccggcggccccggcggcagcggtctcgcgctcgccggattcgtcgcgtcctcgctgcccaaggcggtcgcggcgcagtacgacgtgatcggcttcgacccgcggggcgtgggcagcagcaagccggccctggactgcaagccggggcacttcaagccggtacgcccggactccgtgcccagcactcccgccctggagaaggccaacgtctcccgtgcgacgtccttcgccaaggcgtgcggcaccaagtacgcgagcctgctgccgtacctcgacaccatcagcgccgcacgcgacctggactcgatccgccagtcgctcgacgccaagaagatcaactacttgggctactcgtacggcacctacctcggcgccgtctacgcgaagctctacccggaccgggtacgccggctggtcctcgactcgatcgtcgatcccacgggcgtctggtacgacgacaacatcgcgcaggactacgccttcaacgaccgccatctggcgttcctggcgtgggtcgccaagcacaacaagacgtacaagctcggcaccgacccggccaaggtcggggccaagtggtacgcgatgcgggcggcgctcgccaagaagccggcccagaagaaggtgggcgcctccgagctggaggacaccttcatccccggcggctactacaacggctactggccccacctcgccgaggcgttcgcggcctatgtgaacgacaagaactccgacccgttggtgaaggcgtacgcgaacttcggcgcggtcgacgccgcgggagacaacggctacagcgtctacacctcggtgcagtgccgtgacgtgtcctggccgcgcgactggaaccagtggcgcaaggacaactgggcggtgtacgagaaggcgccgttcatggcctggaacaacgcctggtacaacgcgccgtgcgcgttctggccgacgagttcggcacgtccggtggacctgtccaacaacgcgctgccgccggcgctgctcttccaggcgacgaacgacgcggccaccccgtacgagggcggcgtgaccgtccatcacctcctgcgcggctccagcctggtggtcgagcagggcggcgggaaccacggcatcacgctgagcgggaacgcctgtctggacaagcacctggcgacatatctcaccaacggaaaggtgccgcacggcggcggcgacatcgacgcggtgtgcaagaaggtgcccgacccggcgccgtcgagcaccaaggcgttgccctccgcggcccgcggctcggcgctgcacgggctgctcggcttccgcggctgaggcctcgcgcgaaacggccgcggcccgtcgggggcgttgtcagacccatggtccaccatggacgcatgagtgaactgacccgcgtccccgcccccgacggggtagccgcggcggcgcggggccgccggatcgtcgagcacccgcgcgtacgtcccggtcgccgccgggatgccgcggtggtgggcacgtgaccggcgtcctggtccgggagatgaccctcgacgactgtcaccacgtctccacgatccgcatccgcggctggcagaccgcctacgcggggctgataccccagtcgtacctcgacgcgctcgacctcgacgcggacgccgagcggcgccgcacccatctggtcaagggcgacggcacgatggtgaacctggtcgccgagcgggccggtgaagtcgtcggctgggcctgccacgggccgtaccgggacggtgaagtccgcacgcgggacgccgagttgtacgcgatctatgtacgccccgatgaggtgggcaagggtgtcgggcaggctctgctgcgggagtcgacgcggcggtgcgcgtccgcgggacaccggcacatgttcctgtgggtgctgaaggagaacgccccggcgcggcgcttctacgagcgctccggattcgccccggacggcgccgaggagcccttcgaggtgcacggcgtcacggtgcccgaggtgcggtacgtccgcgccctcggcgctccccaccgaggcgggcgcggtcccgctactcccgaggcgcccgcggccccggcagccgcttcagtgcgcccgccgccgcctgtgcgagcgccggatgcgcgagggcgtccgtgagcacctcccgcgcccggacgtcccccagcgcgccgagcccctccacacacgcgagggcgacccggcggtacgggtcgtgcggccgcagcctccgccggagcgtggtgatcagcgcgggcactgcctcgggggcccgcaactccaccagcagccgcacgggatggagcgcgtaggcgacgcgcagttcattggtggcgagggcggcggccgcccgggcggtgcgcggatcgtcgagccgggccagggcgtacgcggcggacgcgcagcgctgcggatcgcggtggttgagcagcaggacgagcgcctcgaacgcccgccggtccccggccacaccgagccggaaggcgaccagttcccgcgcccacagcggctgtcccggctcggtgagcgcggcggccagctcctccacatcgccggtcgccagcagacgctcgtaggccaccgaggcccccgcctcgttccgtagacgacgctccgtgagtgatcgcaactcttcgtccatgaggccgagcctaggcaaccgactcggtctccggggacgtacatcacaaacacgggggctggcgcgctcgttacccgcgggttaagctcaatcgagcgagttacccactcgcggatttgcttatgacggcctggtgacgcagccgtcgtgagtgctggtcggttcggtacctcaggtacctcatcacggcacggctccgggacagagccggtcggtcctcaccgttccccgggcgtgtgcacgcccccggacggcaccgggcgtgtgcgctcgtcagcccggcaacacccgcactcctcgcatcccttcgcaccgtgtgcgcccgccggcgcacccgcgtgcgctcctcagccgtcaccctcattcctggagtcccgcgatggccactcccccgtttgacccctctctgtccccgctgaagaccgttgccgtgatcggcctcggcacgatgggcaccggcatcgccgaggtcctcgcccgggccggccgcgaggtcgtcggcatcgacatcagcgaggccgccgccggccacgccgtcaccgccctggaggcctcgaccgcccgcgccgtgcagcgtgagcggctgaccgagcaggagcgcggcgacatcctcgcccgcttccgcaccttcaccgaccttcaggccgcggccgacgccgacctggtcatcgaggtgaccccggagtcgtacgagatcaagcagcaggtcctccgcgccctcgacggcatcgtgcgtgcggacaccatcctcgccaccggcaccaacgccctctcggtcacgcgtctcgcggccgactcggcgcaccccgagcgcgtcctcgggctgcacttcttcaacccggcgcccgcgatgaagctggtcgaggtcgtctcgtccgtgctgaccgcgcccaccgccgtcgccgcggtcaccaacctcgcgctcgacctcggcaaggagcccgtcgcggtcggcgaccgccccggcttcgtcgccgacgggctgctgttcggctacctcaaccaggccgccgcgatgtacgaggcgaagtacgcctcccgcgaggacatcgacgccgcgatgaagctgggctgcggactgcccatgggcccgctcgccctgctcgacctgatcggcgtcgacaccgcgcgcaccgtcctggaggccatgtacgccgagtcccgcgaccgcctgcacgcccccgcgccgatcctcaagcagctcagcgaggcgggcctgaccggccgcaagtcgggacgcggcttctactcgtacgacgagcccggcagcgccaccgtcgtgcgggacgcgctgacgccgctctccggaggacccggggagcagggccgtacggtccgctcggtcggcgtcgccggctccggcaccatggcgtccggcatcgccgaggtcttcgcgaaggccgggtacgaggtcgtcctcgccgcccgcagcgaggagaaggcgcagacggccaaggcccggatcggcaagtccctgtcgcgttccgtcgacaagggccggctcacggccgaggccgcggccgagaccctggaccggatcaccccggcgggctcgtacgacgccttcgcggacgtcgatctcgccctggaggccgtcgccgaggacctggagatcaagcagcagctgttcgccacgttcgacaaggtctgcaagcccggcgcgatcctcgccaccaccacctcctcgctgcccgtcgtcgcctgcgcccgtgccacctcgcgcccgcaggacgtgatcggcatgcacttcttcaacccggctccggcgatgaagctggtcgaggtggtccgcacggtcctgaccggtgacgatgtgcacgccacggtccgcgaggtctgcgccaagatccgcaagcaccccgtggactgcggcgaccgggccggattcatcgtgaacgcgctgctgttcccgtacctgaacaacgcgatcaagatggtgcaggagcactacgcgacgctcgacgacatcgacgccgcgatgaagctgggcggcgggtacccgatgggacccttcgaactcctggacgtcgtcggcctcgacgtctccctggccatcgagaaggtcctgcaccgcgagttccgcgacccgggcctggccccggcgccgctcctggagcacctggtggccgcgggctgcctcggccgcaagaccggccgtggtttccgcgaatatgccaagcgctgaccgtcccgacgactggttcgcggacagccccgactggggcggactcctcgatccggccggccaccccccgcccacgccgggcggggggaatcccggacgtgcacgctcccctgcgcagatgcagtacgttcgggtcatgtcccagcccgccaggtcctcacgtaccgcagccacgcccgacgcgccggaaagtgccgcgggcagtcgtgctgccgcccagcggctcaagatgcgccgcgaactggcggccgcggcgatggaactgttcgcgaccaaggggtacgaggcgaccaccgtcgacgagatcgcggcggccgcgggggtcgcgcggcgcacgttcttccgccacttccgctccaaggaagaggcgatcttccccgaccacgacgacaccctggtccgggcggaggcggtgctcaacgccgcgcccgcgcacgagcatccgctcgacacggtgtgccgtggcatcaaggaagtcatgaagatgtacgcggcccggcccgagatctccgtgtcgcgctacaagctcacccgcgaggtcccgacgctgcgcgaggcggagatcgcgtcggtcgcccgctacgagcggctcttcacacgctatctgctcggccacttcgacgagcacgcgcacgacgacgacgcgaacgacgatccgctgctggcggaggtcgccgcgtcggcggtcgtcaccgcgcacaaccatgtactgcggcggtggctgcgggcgggcggtcagggcgatgtcgaggcccagctcgaccacgccttcgccatcgtccgcaagacgttcggcaccgggatcggcgccggacgggagaccgcgccgccccggtcggcgccggcgtcctcgttcaccgacggggacgtgctggtgaccgtggcccgcgtcgacgccccgctggatcaggtgatgcgcaccatcgagcaggcgctcaaggaacggtcgtaggcgcttcgtcaccacaccgcggctgcgccgcgtgtccccaccgccggacgggctcgatttgagtgcgtccggcgtttttgcgccctgctctgatcgatcatcgctcacgtgttacgtaaagatttcatctgagcgcaatttctggcactccgtgccttgccaggtgacacggcgtgccatacgttgaatatgtccgggcggccggcgtgcagagacctttcgtacgccggctgtccccgcaagccaatggcgagcgcgcccggacgcctgcgtcacaggcaccctcctgcgccacaaagcgctgccacagcaccacctccgccgaaccgacggcacccctcacaccagcagcagcaccgacgtaaccctcagcgtctcccctcaagacgccacttcgccggaggcaacaccgtgaaggaaatcctggacgcgattcagtcccagacggccacgtctgccgacttcgccgcactgccgctccccgactcgtaccgcgcgatcaccgtgcacaaggacgagacggagatgttcgccgggctcagcacccgcgacaaggacccccgcaagtcgatccacctggacgacgtgccggtgccggagctcggccccggcgaggccctggtggccgtcatggcgtcctccgtgaactacaactcggtctggacgtcgatcttcgagccggtgtcgaccttcaacttcctggagcgctacgggcggctcagcgatctcagcaagcgccacgacctgccgtaccacatcatcggttctgacctcgcgggcgtcgtcctgcgcaccggcccgggagtcaactcctggaagcccggcgacgaggtcgtcgcgcactgtctctcggtcgagctggagtcgtccgacggccacaacgacacgatgctcgaccccgagcagcgcatctggggcttcgagaccaacttcggcgggctcgccgagatcgcgctcgtcaagtccaaccagctgatgccgaagccggaccacctcagctgggaggaggccgccgctccgggcctggtgaactcgaccgcgtaccggcagctcgtctcccgcaacggcgccggcatgaagcagggcgacaacgtcctcatctggggcgcgagcggtggactgggctcgtacgccacgcagttcgcgctcgccggcggcgccaacccgatctgcgtcgtctccagcgagcagaaggcggacatctgccgctcgatgggcgccgaggcgatcatcgaccgcaacgccgagggctacaagttctggaaggacgagaccacccaggacccgaaggagtggaagcgcttcggcaagcgcatccgcgagttcaccggcggcgaggacatcgacatcgtcttcgagcaccccggccgcgagaccttcggcgcctcggtctacgtcacccgcaagggcggcaccatcaccacctgcgcctcgacctcgggctacatgcacgagtacgacaaccgctacctgtggatgtcgctgaagcggatcatcggctcgcacttcgcgaactaccgcgaggcctgggaggccaaccgcctcgtcgccaagggcaagatccaccccacgctctccaaggtctactccctggaggacaccgggcaggccgcctacgacgtgcaccgcaacctccaccagggcaaggtcggcgtgctcgccctcgcgccccgcgagggcctgggcgtgcgcgacgaggagaagcgcgcgcagcacatcgacgccatcaaccgcttccggaacatctgaggtcacgtagatgactgagcgtcagaccagcgacgggcggcgggagaaggaccggccgtggctcatgcgcacgtacgccggccactccaccgccgaggcgtccaacgagctgtaccggcgcaacctcgccaagggccagaccggcctgtcggtcgcgttcgacctgccgacacagaccggctacgaccccgaccacatcctcgcccgcggcgaggtcggccgggtcggagtccccgtctcgcacctcggtgacatgcgccggctgttccaggacatccccctggagcagatgaacacctcgatgaccatcaacgccaccgccatgtggctgctggcgctctatcaggtcgtcgccgaagagcagggtgcggacatcaccaagctccaggggacgacccagaacgacatcgtgaaggagtacctgtcgcggggcacgcatgtgttcccgccgggtccttcgctccgtctgacgacggacatgatctgctacacggtcaaccacatccccaagtggaaccccatcaacatctgtagctaccacctacaggaggcgggggccacaccggtccaggagatctcgtacgcgatgtccaccgcgatcgccgtgctcgacgcggtcttcgcgtcggggcagatccccgaggaccgcaagggcgatgtcgtcgcccgtatctccttcttcgtgaacgcgggcgtccgcttcgtcgaggagatgtgcaagatgcgcgcgttcgggcggatctgggatgagatcacgcgtaagcggtacggcatcgaggaccccaagcagcggcgcttccggtacggcgtgcaggtcaactccctcggtctgacggaggcgcagccggagaacaacatccagcggatcgtcctcgagatgctggccgtgacgctctcgaaggacgcacgcgcgcgtgccgtacagctgcccgcctggaacgaggcgctgggcctgccgaggccctgggaccagcagtggtcgctgcgtatgcagcaggtgctcgcctacgagagcgacctgctggagtacgcggacatattcgagggctcgcacgtcatcgaggcgaaggtccaggagctggtcgaggagtcgctggccgagatcgaccggatccaggagatgggcggcgcgatggccgccgtcgagtccggctacctcaagtcccagctcgtcgcctcgcacgcggagcgccgggcccggatcgagtcgggccgggagaagatcgtcggcgtcaacatcttcgagtcgaccgagccgaacccgctgacggccgacctggacgcggcgatccagacggtcgacccggcggtcgaggcccgggtgatcgcggcgctggggacctggcgcgacacccgctaccagccgcccttcaaccacccgcgcccgtgcaaggcgctggagaagctgaaggaagccgccaagggcaccggcaacctcatggaggccaccctggagtgcgcccgcgccggggccacgaccggcgagtgggccggggcgctgcgcgaggtgttcggcgagttccgcgcgccgaccggtgtgtcctccgcgccggtcgccgtcaccgccgaggcgggcaccgcgctcgcgctggtccgtcagaaggtggagctgaccgcgaaggacatgggcgtcggcaagctccgcttcctggtgggcaagccgggcctggacgggcactccaacggcgccgagcagatcgccgtgcgggcccgtgacgccgggttcgaggtggtctaccagggcatccggctgacgcccgagcagatcgtggacgcggccctggccgaggacgtgcacggcgtcggcctgtccatcctgtccggttcgcacgcgcagctcgtgcccgacgttctcgaccggctccgcgaggccggcgcgaccgacattccggtgatcgcgggcgggatcatcccgaacgcggacgccgaacagctgcgggccgcgggagtggccgcggtcttcaccccgaaggacttcgacatcaccggaatcatcggccgtatcgtcgacgagatccggaaagcgaacaagctcgaccccctggaggtccccgcatgaccacgcccgtcaaccgcctgcgcccgcgacgctcctgcctcgcggtgccgggaagcaacccccgcttcctggagaaggcccagggcctccccgccgaccaggtcttcctcgacctggaggacgcctgcgccccgctcgccaagcccgaggcgcggcacaccatcgtgaagttcctcaacgagggtgactggacgggcaagacgcgggtcgtgcgcgtcaacgactggacgacgcagtggacgtaccgggatgtcgtcacggtcgtcgagggcgcgggccagaacctcgactgcatcatgctgccgaaggtccaggacgcccagcaggtcgtcgcgctcgacctcctgctcacccagatcgagaagacgatgggcttcgaggtcggcaagatcggcatcgaggcgcagatcgagaacgcgcagggcctgaacaacgtcaacgagatcgcgcaggcctcgccgcgcgtcgagacgatcatcttcggcccggccgacttcatggcgtcgatcaacatgaagtcgctggtcgtgggcgagcagccgcccggctacccggcggacgcctaccactacatcctgatgaagatcctgatggccgcccgcgccaacaacctccaggcgatcgacggcccctacctccagatccgcaacatcgacggctaccgcgcggtcgcccagcgcgccgcggccctcggtttcgacggcaagtgggtgctgcacccgggccaggtcgaggcgtccaacgagatcttctccccctcccaggaggactacgaccacgccgagctgatcctggacgcgtacgacttctacacgtccgaggcgggcggcaagaagggctcggcgatgctcggcgacgagatgatcgacgaggccagccgcaagatggcgctggtcatctcgggcaagggccgggccgccggcatgcagcgcacgtccaagttcgaagccccggaggcctgagcaccatgcagttcggacgcacgtacgaggagttcgaggtcggcgcggtctacaagcactggcccggaaagacggtcacggagtacgacgaccacctcttctgtctgctgaccatgaaccaccacccgctccacatggacaccaactatgcggagaagacgacggacttcgggaagaacgtcgtcgtcgggaactacatctactcgctgctgctcggcatgtcggtccccgacgtctcgggcaaggcgatcgccaacctggaggtcgagtcgctgaagcacgtggcgccgaccttccacggcgacacgatctacggcgagaccacggtcctcgacaagacaccctccaggtccaagtcggaccgcgggatcgtctacgtcgagaccaagggctacaagcaggacggcacgctggtctgcgtgttccgccgcaaggtgatggtccccaccgagacgtacatcaaggagcgcggcggcgagcagcccggccgcccggagctcaccgcacctgcggagaagaagacggagaagtagccatggcgcgactcgcccagaccgccggtctgaccgacatccagcaggagatcctctccaccgtccgcgacttcgtggacaaggagatcatcccggtcgccaccgagctggagcaccgcgacgagtacccccagcagatcgtcgacggcctcaaggaactgggcctgttcggcctgatgatcccggaggagtacgggggcctgggcgagtccctcctcacctacgcgctctgcgtcgaggagatcgcccgtggctggatgtcggtgtccggcatcatcaacacgcacttcatcgtggcgtacatgctcaagcagcacggcactcaggagcagaaggaccacttcctgccccggatggcgctcggcgaggtgcggggcgcgttctccatgtcggagccggctcttggttcggatgtgtccgcgatctcgtccaaggcggtcaaggacggcgacgagtacgtcctgaacggccagaagatgtggctgacgaacggcggctcgtcgaatctcgtggcggtcctcgtccgaagtgacgaaggacaccccgagggcacggcgccccacaagtcgatgacgaccttcctggtcgagaaggagcccggcttcggagaggtccgccccggcctcaccattcccgggaagatcgacaagatgggttacaagggggtcgacaccaccgagctgattatggacggactacgcgttccggccaatcgggtactcggaggcacgaccggccgagggttttaccaaatgatggacggagtggaagtcggccgcgtgaatgtagcggcccgtggctgcggtgtggcgcagcgtgctttcgaactcggcgtctcatatgcccagcagcgtcacactttcggcaagccgatcgcccagcaccaggccatccagttcaagctcgcggagatggctaccaaggtcgaggccgcccatgcaatgatggtgaacgcggcccgcaaaaaggattccggggaacgaaacgacctcgaagcagggatggcgaagtacctcgcgtccgaatactgcaaggaagtcgtggaggacgctttccggattcacggcggttacggcttctccaaggagtacgagatcgagcgcctctaccgggaggccccgatgctgctgatcggtgaagggaccgccgaaatccagaaaatgatcatcggacgcaggctgctcgaagagtatcgactccagggctagatgtccgggttcggggtgttttcatcgagaagaagatcacaccccgtcaacactcttcggccgccgactcggcttcttggcttgcccagttgcggcccgcgaccggtacgatcccgggaaagccgccgtcccccgttacagcgcggcatcatccgctacgaaggtcatccatgccccacagccaaacctctgcacctcgcggccgggtccgcctcgcgcgcggagcatcgccgtggcttctcccgaccgttgccaccgcagcactcagcctggtccgggcgcgccgctccggcgccgccaaggccgtggccgtacccgccaccgcactggcggcgggcatgctgtggttcttccgcgaccccgagcgcgagatcactcagggccgggtcatctcgcccgccgacggcgtcgtccagagcatcatgccctggaaggacgggcgtacacgcgtcgcgatcttcatgagcccgctcaacgtccacgtcaaccgcgcgccgctgtccggcacggtgacgtctgtcgagcacatcccgggtgggttcgttccggcgttcaacaaggagagcgagaacaacgaacgcgtcgtctggcacttcgacaccgagctcggtgacatcgagatgatccagatcgccggcgcggtcgctcgccgcatcgtcccgtacgtgccgcagggcaccaaggtcgagcagggcgaccggattggcctgatccgcttcggctcgcgcgtcgacatctacctccccgagggtgtcgacgtcgacgtggaggtcggtcagaagaccgtggctggggtgactcgaattgaccgtgattgatcctgagacacagaccggctgggtgccggaggccgacgaggtggacgacgaggaggagatgcccctctccctccgcctctcaatagcggacacgctgactctcggcaacgccacgtgcggcttcatggcggtgtacttcaccaccaccggcatcctgatcccgcacctcacgggcagccaggagtcgggcatggcccggcacagcgcggccacggcggtcatcctgatgctgtgcgcggcggtcttcgacctcttcgacggcctcgtcgcccgcaagctgcgctcctcacccatgggcgcggagctggacaacctctccgacctgatcagcttcggcctggcaccggcgtacttcgtgctggtctacggcatggtcgcggacgacgcgcaccagagagtggcggcggtgggggccatcgtggtcctcctcgcggtcgtcctacgcctcgcgcgcttctcctgcgtgacggtcaaggacggcacgttccagggcatgccctcgccgttcggcgcgctgacggtcgtctccatcgtgctcctcgagctgccgttcgtcgccacgctcatggcgatcatcggcaccgcctggctgatggtgagccgagtcgagtacccgaagccgcggggtcgtctcgcggtggcgatgctctcctggatcgtgctgtcgatgggcctgctggcggcgtgggccttcgacgcccccagcggccagctgctcctccagacgggctgcgcgctccagctggtcatgggcgcggtgatccccctcttcgcgacggcgcggcgggtgaacaacttccgcgacaaccgccgtgaggcgcgtgccgcgcagttgccgtagcggattggtcgtaacgagtacccgaagggccccgagccagttggctcggggcccttcggcgtgtgccgcgttcccggccgctccggcgtctgccgggctcagaccaggaagtcccgggcgatgttctccgcgacccgctccaggatcggccccgcgtcctcgatgcacttcgcgatgtccggctcggactccgtcagcgggtacgcccgccggatgccggcccgccccagctcctgcggcggcagggcgagccgcccgcacaccgcgacgacctccttgcccgccgcccgagctgccgcggccacacccgccggcgccttcccgtgcagcgtctgctcgtccagcgacccctcgccggtgatcacgagcgtggcgcggtccagcgccggcgcgaagccgagcacgtccagcatcacctcgatgccgggccggaacccggcgccgagcaccagcgccccgtacccgatgccgcccgcggcacccgcaccgggcgcggcggcgtactccgcggccttcggcccgatcgccttctccagcaccgccgcgaagtgcgccagcgccgcgtccagcgtggccacgtcgtccggtgcggcgcccttctgcggcccgtacaccgcgggtgcgcccttcggcccggtcagcggattgtcgacgtcgctcgcgaggaccagctcgatctccgcgaggcgggggtcgaggcccgagagatcggccagggcgagctcgctcagtccgccgcccccgggagccaccggctcgccctccgcgtccacgaagcgcgcaccgagcgcggccagcatgcccgccccgccgtcggtcgtcgcgctgccgccgaccccgaacacgatggtccgcgccccggcgtccagcgcggcccgcagcagttccccggacccgtacgtcgacgccgtgagcggcgcgaagacacctttgggcagccgttgcagcccgctcgcctccgccatctccacgaccgcggtgccgccgcgcagcgcgaacgccgccgtgacctcttcgccgagcggcccggcgacccgcaccgcacgccgctcgaatccggccgcgaccgccgcgtccacggtcccgtcgccgccgtcggccacaggcagcgcctcgacctccacggcgggcgcgacccggcgcaggccggccgtcacacgctccgcgacctgtacggcggtcagcgaccccttgaacttgtccgcggcgatgagcaccctgcgggtcccgttgactccagcgtccgccaccttgcattccccttgctctccgggccttgctcacgtcaaggcagtcgcgccgcagcgaccttaaccgcaggacgcactcgccgtcatgccccgccgggcccccggaacacagcgcatccgcccccggaatcgggtacaccgaagctatgacccctgtgggcaccgaaccggatctcgccgaccgcgtcctcggcggctggctgggccggatcgcgggcaacatgctcggcaaaccggtcgagcagggcgaccactggacgcgggagcgcatcgaccgctatctgcggcaggccggggccctgccgctcaccgactatctccccgagcccgtcggcccgggcgccggcgacgagttcgcgctgcgccccgagtggcgccagtgcgtacgcggccgtatccacggcagctgccgggacgacgacgtggactacgcgatcctcggcctccacctcctcgagacgcacggcttcggcttcagcacggagcaggtgggcgacctatggctgctgcggctgccgtacctccagacgttcacggcggaacgggcggcctaccgcaacctcgcgggcggcatcagaccaccgctcaccgcgacgtacgagaacccgtaccaggagtggatcggcgccttgatccgcgccgacatctacggctggacgtgccccggcgctccttggcgcgcggcctcgctggcccgccgggacgccgtgctctcccacaccggcaacggggtgtacggcgcgatgtgggcggcggcactgatctcggcggcgttcacggcacccggggtgcgggacgccctggacacggccctgacggtcatccccgcgagcagccgcctcgcccgcatcgtgcgccgcgtcgcctcgctgcacgagacccggctgagctgggaggacacgctcagcacggtggccgaggagacggcggggctcggctggatccatacggtcccgaacgccgcggtcctcacggcggggctcctgtacggcgacggcgacttcacccgcacgatcacactgacggtgcgcggcggcctggacaccgactcgaacggcgcgacggcgggctcggtggcgggcgtcctcagcggggcggccgcgatcccgccccagtggaaggacccgctggaggacacggtccgcagtgcggtgttcggcttcgacggggtacggatcagcgaactggccgcacgcacgctcgcactggcggagacggaaccggagacgggggccggcccggagacgggggccgccgggaccggtctggacactccgtagcgaggcacagcacggcgaggcgggggagaccgggccggaggaacggtcgacgaagtccctgccgggagcgccgagttcgccgcgccgtggcgggatcacgacgtcacggcgttccactcctcggtccgccgctgcgccacccggaacgtccgcgcggactggatacccttccggagtgaccactccacaagacttcgccacgtacatcgcgggcctcccccgcgtcctcgccggtgccgccgtgctcttccgtgacgccacgggccgggtgctgctggtcgagcccagctaccgggagggctgggcgctgccgggcggcacgatcgagtcggacgacggggagacaccgaggcagggcgcacgacgggagacggccgaggagatcggactcgacgtcgagccgggccggctcctggcggtggactgggtgcccggaacggcccgcccacccctggtggcgtacctgtacgacggcggcgttctcggcgaggaggacctcaaggcgatccgcctccaggaggaggaactgctgtcctggcgcctcgtgccgcgggaagagcttccggaatacctttcgggcgccctgggccgtcgcgtcctggccggactcgacgcggtggccgagggtgcggggacggcggagctggagaacggacaccgggtgggctgatgccgccgggcccggtcagtcaggagctgaggatcctgcgcttctgttcctcgaattcggtctcggtgaggacaccctgggccttgagctccccgagctgcttcaactgatcgatcttgctgctcatgtcgtcggcaggcggggcgggagggggctgggcggccggcggggcctcctgatactcctgctgggcccatcgcccctgctggcggcgtgacacgcggttcgacacggcggtcgccgtaccggccactacggctgtgcgggcgaccccgcggcaggagacctggcacggcggtttcctttcttgcaggatgcatgctccctgccgaaggcacgcgtctcgccggaggcatgcgacacaaacagtccaccgagcgacacacaattctcggtgcaccggacactcccattggagcaccggatgaattccctcgcacatcggccttcgtgctgccctgcgtaaataccgacgttctgccggactgtgattctcgtggcaagctgaaatgtggccaccggccggttcgctggtcagtggcgaggcctacgtgggaggagctcacaatgaccacgactggaatgcagcagcggcacgggaccggaagtggcagcggaggagcctgggtgtccggctggaccgcattcgccggggccatgatgatcctcggcgggacgatggcggtattcgaaggaatctccgccatcgtccacgacgatgtcttcatcgtcaccaacagctactcctacaacttcaacctgacgggttggggctggatccacctcatcctcggcattctggtcttcttcgccggcatcgccgtgttccgtggtgagctgtgggcacgcatcaccggaatcgtgctggccggcctgtcgatgatcgccaacttcatatggctgccgcactcccccttctgggccatcgtgctgatcgtcgtggatgccttcgtcatctgggcgctgtgcgtcggaaccgaccgggacgccgcccgcaccaccgcctagcggcctagctggccgcgccgtcccgggcaacccggcgggtgggtgttgggccgttcggcaccggacggcaccccgaccggctgaaaggagacgtgccaccgagccgtactgatccacccatgttttcttggtggggcggattcctccggatctccgcatcggcacccacagggagacacgagtggaaaccaccggaagtgacggtcgccagccccttgccccccagctcctcaaaggacagaaggcgctggtgacgggtgcgaattccggcatcggcaaggccacggcgatcggcctgggacgcgtgggcgccgatgtggtggtgaattacgtggccgggcgggacgccgcggaagaggtggtgcgcgagatcgagagtttcggcgtccgcgcctacgcacacgaggcggacgtgtcacaggaggaccaggtcgccgacatggtttcccgtatggtcaaggagttcgggaccatcgacgtcatggtggcgaatgcgggactccagcgcgatgcccccgtcatcgacatgaccatggcccagtggcagaaggtgctggacgtcaatctgaccggacaattcctgtgcgcccgtgaagcggccaaggaattcatgcggcgcggcgtcgtcccggaggtttcacgctcggcagggaaaatcatctgcatgagttcggtccaccagatcatcccctgggcgggccatgtgaactacgcggcgtccaagggcggggtgctgatgatgatggcgaccctcgcccaggagctggcaccccaccggatccgggtcaacgccgttgctccgggggcgattcgcacaccgatcaaccgcagcgcctgggacaccccggaggccgaggccgaccttctccggctcatcccctaccgccgcgtcggcgacccggacgacatcgcgaacgcggtggccgctctggcgtccgacctcttcgactacgtcgtggggaccacgatctatgtggacggcggcatgacgctgttccccggtttcgccacgggtggctgacgcccgctgcccctcagcagccgtccggcacgagccaccgaggcccatgtgaacagcgcgatcgaccacttcctggccaacgccccggcacagcttctgccggcccgggagctgatggccttcaccctggcctcccacatcctgctcgtgcccttcggcgtggccctgcccgccatcaccctcctgatgcactaccgcgggctgcgcaagggcgacgccgtcgcgctgctgctcgcgcggcgctggtcggcggtcatggccgtccagttcgccatcggcatcgtgaccggcacggtgctctccttcgaattcggtctgctgtggccgggcatgatgggccggtggggcgatgtcttcggcctcggtttcggggtcgaggcatgggcgttcttcctcgaggcgatcctcatcgcgatctacctgtacggctggcgccggctcaagccgtggacgcacttctggctcggcctgcccctgccgctggccgccctgatggggggcgttcggcatcgtggccgcgaacgcctggatgaacaccccgcgcggcttcacgctcgacgcgtccggcaaccccgtgaacgtcgacgtgcggcgggcggtcttcacgccgatgctcggccccgagtactggcacttcgtggtcggggtgatcctcaccgccgggtatgtcgtcgccggggtgtacgcggtcgggctgctgtggggccgccgggaccgctaccaccggctcggcttcaccgtgccgttctccgtcgccgcgatcctcacccccgtgcagttcatcctcggggactcgatcgcccgctccgtcttccacaagcagccggtgaagttcgcggccaccgagatcgtctggaagaccggcacccatatgccggagtacatgttcgggcgtctgcgttccgacgggtcgatctccggcggcatcaagatcccccagctggactcgatcctcgccggattcagcgtgaacaccaaggtgacgggcctgtcgtcggttcccgcgagcgaccgcccgaccgcgactcaggccacgatcgcccactgggcgttcgacatcatggtgaccatcgggagcctgctcgtcctgctcgccctctggtacggctggtgttggctgcgccaccgtggcctgcccaggtcaccgtggttcttccggtgtgccgctgtcgccggcgccgcctgcctgctgacggtggagtgcggctggatcacgaccgaagtgggccgtcagccctggatcgtctaccagaacatgcgggtctcggaggcggtgacggacacccgtgcctcgtctctgtgggcgatgctcggcatcgtcgtggtggtctacgtactcgtcctcggtgccttcctggccgtcctcctgaagatgagcagccggtggcggctggccgacgaggacgctctcgcgggagccgccgccgaggatctggaggacgacaccccctacgggccccgcccgttgtccacgaccggaagcgggcacagaggcgggaacaacgacggcggcagcggcagggacacggacaggggcggcgaatgatcgaggacgtcgtcgcctgggtgctgctggccgtggtggccgcgtacgcgtgcgccggcggcgcggactacggcgccggattctgggacctcgtcgcgggcggccccgaacgcggcaaacgccccaggtggctcatcgaccacgccatggaaccggtgtgggagaccaacaacgtctggctcatcttcatcctggtcatcatgtggacgggcttcccggtcctgttccagacggtcttcacggccatgtggctcccgctggcactcgcggccgtgggactcgtcctgcgcggcgccggcttcgccctgcgcaagcccacccggcgcctcgcccggcgcaggatcgtcggcgccgtcttcgccctctcctcgcttcttacgcccttcttcctcggagcggccgtcgggggtctcgccacgggccgggtggctccgggcacgaaggcgtccgccgacgcctgggccaacgggacgtccgtgatcgccggactgctcaccatcgccgcgaccgccttcctcggagcggtgttcctcaccgccgacgcccgccgcttcgatgccgccgacctcgtcggatacttccggctgcgggcctggtgcagcctcggcgtcatcgccgtactggcggtcgtcgggctcgccgtgacccacgacgacgcgcgctacgtccacgacgggctgaccggcggaatcggtctcgccctcgtcctggtcgccgtcgtcagcgcgttggccaccgccgggctgctgtaccgaacggcgacgggatgggcgaggatcaccgcggtcggcagcgtggccctcgtcgtcgtggcgtgggggctggcccagcggccctatctcatccccacctcactgaccgtgtccgaggcggccggcgcgtcgacgacgctgcgctggctgatgctggtcacggtcatcgcggtggtgctcgtcggaccgcccctggtcctgctctaccggctggacacccgcggagccctccagcccctcacggacgcggacctgcggcggacggcgtccggccgggatcccgagaacccgtgaccggggccggggccggggccgggatccaggccgccgaggagtcgccgatcgtgttggtcgtgggggtgacaggctccgggaagaccaccgtcggcaaggccgtcgccgagcagctcggactggagttcgtcgagggcgacgacttccatcccgccgcgaacatcgccaagatgaccgccggccacgcactggacgacgccgaccgcgagccctggctacgtgccctcgccgaccgcatccggcactccgccgcggcgggcgaggggctggtcgtcgcctgctcggccctcaagcgcgcctaccgcgacaagctccgggcggccgcgggcccagggctgtggtgcctgtacctcgccctcgaccgggacaccgcccgggaccgcgtgtcccggcgcaccggtcacttcatgcccgcccagctggtcgactcacagttcgagacactggagccgctggaaccggacgagccgggcatgaccatggacgccacggccgccctcgcgacgatcctcacccgggtgcgggccgccgtcccgcgctccggcaggggcacggccccctgacgggtcagccgctcaggagtacggcgacgcctccggtccgctgtgccggaccgccggtacgggcgacgcctccggcccgcggtgccgcaccgccggtacggacgggggagaccctcctgggcccgtcccgcgacccacggtggcgcggccgctacatcgtcggcggctgatcggcgtccgtcgcgtccagcgcggccaggatggccggtaccgggatccgcccggaggcgaccagttgcgcaccgccgcgtcgcagggcggtggcgaagggcgcggcccacaggttctcgtagaccaggattccggcggagttgccgggctccagggcggcgcccgcctcctcgatgtcgtcctggcccagcaggccggaggacgcgccctcgaagacggccaggtccagagctccgtcgccggtgaggtcggcgatctccaggccgaccacggatccgtccttttcctttccgacaaacatcagatcgaggattcgaatgatgccgcggtccaccagatcgaccagcagaggaaatccctcgcccgtcattcggttaccgggaaactcgacgaccagatagtcgatcggacccatttcgacggattcatcgctcacagcttcacccctgggtggtcacggaattcccccggtcgccgaatgccattgcgccatcgtccccgaatgccattgcatcatcggacggaagcctccgcacctcggtgcggtattcacccctcggtgcggtattcacccgccgggcccgtccgggtcgccggatcgggtccgtacggatctcctgtgaccatgaccagcagcgcacctccaccggacccggaccagcactccgcggacccgtccggcgaccagcggctctcggcgcgggagcgcagcgagctggacaagctgcggcaccgggtgagcgccctggagggcgccgggccgtcgggggccgggccgtcgggggccgggcggcaccactggctccggtcgacgggttcggtcctgctgattctcctggcctcgctgctgtcgctgctggccgtcgtcgcggtctgggcgaacagcatcgtgcgggacacggaccgctatgtcgccacggtcgggccgctggcgggcaatccggacgtgcagaaagcgatcaccaaccgggtcaccagcgcggtcctcgcgcagatcgacgtggaggcactggtcaaggagctggagcaggcggcggcgcagcagggtgccccgccgaaggcggcccagttgctcggcgacctgagcggcccgatcacgagcggcctgaagagcctggtcagcagcaccgtccagcgggtggtctccagcagtgccttcgacacgctctgggtggacgcgaaccgctcggtccacagcgctctggacaaggccctcacgggccacgacggcggtgcggtgtccctcaagaacgatcaggtcgccatcgacgtggggccgatcgtggccaaggtcaaggaccagctggtcagtgccggcttcaagcccgccgcccggatcccggccgtgcataccgacttcgtggtgttcgcgtcgaaggacatcggcgagatcaagacgtatctgcgggtgctggagatcatcggcaactggctccccgtcatcgccgtgctgatcggcgccgtgggcgtgtacctggccgtcaaccgccgtcgggccctgatcgggatcgcgtcgggggtgttcgccgccatgctgctgctcggcgtcgcactcaccgtcgcccgggcgatctacctcgaccatctgccctccgggacgtcagacgccgccgcgggcgcggtgtacgacgcgctggtcaagttcctgcgcgcgagtgtgcgggcggtcggtgcgctcgccctcctgacggccgtcggcgcgttcctcagcggcccgtcccgggccgccgtcctcacccgtacgggctgccgcaggagcatcggcgccctgcgcgacgtcgccgtgtcggcggggctcccgctgggtgcggtcggccggttcgtacaccgttacaagcggtggatcggcggcgtgatcctggtggtcgccgcggtcgtcctgttcacctggagctatccgaccacggctgtcgtggtgtggacggtggtgatcgtgctggtggccttcgcgatccgcgagttcctggacgcgccgcctacggagcccgcctgaccgcgccctcgtgccggcgttcgctcacccgccgccagatcgcccgctggcacttgagcgtgccggtcccgaccacgatcagtacgacgatgttgagcagcagttggaacagggaaccccgggcctcgtcccagctggcgaacgcgcacgagaccccgatgtcggcccccgccggaatggtggtcaccgagatgaagacgccgagcagtgcgctcgtccgggcctcggcgagcgagacgatgccgacgatcccggccagcaccgccaccacggccgagaagaagttgggggtgtcgatcagattcgagacgggcctgatccccagctcgaaggccgtcggctgcaacccggagccccggaccacgagggcgaagaggaaggtcgcggcaacggccagcaggaagcccacgagcagggccacgaggccccgctggattctcggccgggagtggtggtcgatcccgagggcgatgctggtgatggccccgtactcgggtccgaccaccatggccgcgacgatgaggatctgggagttggtgatgatgccgaccgcgccgatgattccggcgatgaccaggaagaggtagaagctcggggggtacctgccctcggcccggatcctggcctccacctgctcccacaccggtgcgcgcagccgggccccgagccgctcggccccggtcctggccgcccgctccgagaacaccatgtcgaccgggtcgaggacgatggaaccgtcgtgttccagtccgagggcccgcaggccgcgcagcacctcgttcgcggctccggtcaggacgtcgcactcgatggcgtcgccgtcggggttgcgtacgccgcccgtctgcaggaccaggttcaggacgcacggctctgcgctcagcagggccatggtgcgttccgtgaggtccggcgggcacaccgctcggacatggatcatgtccatccggacctccgcgggtcggtgcggtgcgccggccgtggcccggacaggtcactcacccattaacgcggcggcccctgagcgcggcaactcggcgggcggacccccggcacctgccgcagggtggggacatgcggacgcccgacgagctgagcgaggccggcttccggtcgctctaccgacatctgcgcgacacggcccccggcggcggcacacgccggggcgccctggacaccatcagcgccgaacaggtgctggcggccgtccgcgaggtgcggtcgggacgtacggtgtcgctggccgcccccgtcaacacccatgccgcgccggacgacgccgatccggccgagcaccggctcaccgctccggccgacggcgaaccggacccgaccggagtgcagttcgcgcgggaccgcatcgccatgaacattcacggcgatgtgaacagccatatcgacgcgctgtgccacgtcatctacgacggcaccctgcacggtggcataccggcggcggacgcgctgtcgccggacggggcgagcgccctgtccatcgccctggcccgcgacggcatcgtcggacgcggggtgctcctcgacatcccccagctgcacggcgtcccctggctcgaaccgggatcgcaggtgacggccgaggacctggccgccgccgaggcggggcagggggtccgggtcggccggggcgacatcctcctcgtacgggtcgggcatcgccgacggcgtgcggagctgggggcctgggacgtggccgacgctcgggccggactccatccggccgccatggagttcctggccgagcgggaggtggccgtactcggcagcgacggcaacaacgacgcggctccgagcgcggcacagggcgtcgcgttcccggtgcatgtgctcgccatccacgcgatgggactgcatctgctcgactatctgcggttcgaggacctcgtaccgctctgcgcgcgggacggccgctggtcgtttctctgcgtgatcgcccccctgcggctgcccgcggccaccggctcccccgtcaatcccctcgccatcctgtgacggccgtcggcccccgctcacccgaccggcccaactcgccggaaacatcacccggagatacgttggtggttggggccgatgtccccttcaccgggcaggacggacgatgttccgaggacggtggccggcatgaccgacgcgcggcactacgacgtcatcatcattggcaccggtgcgggcggtggcacgctcgcccaccgactggcccccaccgggaaacggatcctcctgctcgaacgcggtgactacctgccccgcgaacgcgacaactgggaatccaccgcggtcttcgtcaagggcaaataccgcgctccggagttctggtacgacaaacacggaaaccagttcccgcccgaagtcaattactacgtcggcggcaacaccaagttctacggcgccgcgctcttccgtctgcgccccgaggacttcggcgaactccgccaccacgacggcatctcccccgcctggccgctgagctacgaggaactcgagccgtactacacgcaggccgaacacctctacctcgtccacggccggcacggcgaagacccgaccgagggtcccaccagcgcccagtacgcctacccgccggtccagcacgagccgcgcatccagcaactcagccacgacctggagaagcaggggctgcaccccttccaccttccgatcggggtgaacctcacccaggacgaccggggccgggccacccacgccagcgcctgcatccgctgcgaccgcgtcgacggcttcccctgtctggtcggcgcgaagtccgacgcgcaggtcatctgtgtcgaccccgccctggagcacgccaacgtcgagatgctcacccatgcggatgtgcggcgcctcgacacggacgcgaccggacggagtgtcacctcggtcgtcgcgacggtgggggacggggccgcttccaccgtggagttcagcgccgacatcgtggtcgtcgcctgcggcgccgtcaactccgccgtcctgctgctgcgttcggccgatgaccggcatccgcagggcctggccaacagctcgggcgtggtgggccggcactacatgcggcacaacaacctggccctgatggccgtgtccaaggaaccgaacgacaccaaattccagaagaccctggcgctgcacgactggtacctgggatccgacgactgggactaccctctcggcggcatccagatgctcggcaagtccgacgccgagcagatccacggcgaggcgccccgctgggccggggccgtcgcccccgacatgccgttcgaggtactcgcccaccacgcggtcgacttctggctgtgcggagaggacctgcccctcgccgagaaccgcgtcaccctggacggggacggcggcatccatctggcgctcgacgagaagaacaacatcgccgggctgaagcgcctgcggcacaaactacagggcatgctcagccacttgggcatgcacgagcaccatctgctgtcgcacagcatctacctgcacaagggcatgcccatcggcgccaccgcgcatcaggcgggcacggtccgcttcggccgcgaccccgccgactccgccctcgacgtcaactgcaaggcccacgacctcgacaacctctacgtcgtcgacacgagcttcttcccgagcatcggcgcggtgaatccctcgctgaccgccatcgccaacgccctgcgggtcggcgaccatctcgcggagcgactgcggtgacggcgggccacccggccgaccacgagacccgacaccgcacgccgcgggagcgagccgcactcggcaaggccgcccggtcctccgtaccccgctccagtcacgccgagttcgcgcccccgcagaagcggcccgacccggtggacgtcgtcgacgcgcagtcggcgacgcgggtgcccgagctcgtaccgatccgctacggcaggatgaccgagtcgccgttccgcttctttcggggggccgccgccatcatggcgggggatctcgccggcactccccggtccgggttcaggacgcagctgtgcggcgacgcacacctgctgaacttccggctgctggcctctcccgagcgccgcatgatgttcgacatcaacgatttcgacgagacgctgcccggcccgtgggagtgggacgtcaagcggctgaccaccagtctcgtcatcgcgggccgggcgaacggcttcagcgccaaggagcgggccggcatcgtgcggtcgacggtgcggtcctaccgcgagtggatgcggcgcttcgccggatggggcaatctcaccgtgtggtacgcccagttcgacgaggagtgggtgcgcgcccacttcatagacgaggcgagcgcggggatccgcgacagttggtcgcaggcggtggcgaaggcacgtacccgggacagtctccacgccttcggccaactcacccacatcgtcgacgggaaggtccgcatcgccgcggatccgcccctgatcacgccgctccaggacctgcttccggatgtcgaacgcggcgcgctggagaaggagatccgccggctgatcgaacgttacggccggacccttcagtcggaccggcggattctgctggagcagtaccgggtggccgacttggcccgcaaggtggtcggggtcggcagcgtgggcacccgctgctggatcgtgctcctgctcggcagggacgacaaggatccgctgctcctccaggccaaggaggccgacgagtcggtgctggcgcccttcgccggcgcgagcggctaccggacgcagggcgagcgcgtggtctccggccagcggctcatgcaggccaccagcgacatcttcctcggctgggagcgggtcgacggcatcgacggccgccgacgagacttctacgtacggcagttgcgggactggaagggcatcgccgagcccgaggtgatggtgccggccggcatgcgggccttcggtgagctgtgcggtgccacgctggcccgcgcgcacgccaggtcgggggaccggatcgccatcgccgcgtatctgggcggcggcgatgtcttcgaccgggcgctggtgacgttcgccgagcgctacgccgaccagaacgagaaggaccaccaggcgctcgtcgacgccgtccgcacgggacgggtagcggctgaagccgcctgaaagggagaccaccaaggaggccagcatggaacgctacccgcccatcgccgaccacgggctcgtcggggacctccagaccgcggcgctggtgtcgtcccagggcgtgatcgactggttcgcggcaccgcgtttcgactcgcccagtatcttcgcctccctgctcgaccacgacggcggcggccatttcctcctcgcgcccgagcaccccgaggggacctggaggcagctctactacccggacaccggcgtcgtggtgacccgcttcatgtcacccgacggagtcggcgagatcatcgactacatgccggtcctgccgggcccgacggcgagcgaccggcacagcctggtgcggatcgtacgctccgtgcgcggcaccgtgcgcttccgcctcgtgtgccggccgcggttcgactacgcgcgggccacccacgaactggacctgacgcccgacacggcgacgttccgggccccgggaacgaccgcgttccttcagtccaccatcccgctcgaacgggacgagcaggacgtccgcggcgccatcaccctcaacggcggagagtcggcggccgcggtgttcaccgtgtgtgcgccgggcggggaggcgccgccaccgcccaccacggagcggatcacagaagagctctgggagaacatcgcgttctggcacgggtgggtgcgcacctcgcgctaccacggccgctggacggacatggtgcaccgctccgcgatcaccctcaagctcctcacgtacgcgcccacgggcgcgccggtcgccgccgccaccatgggactgcccgagcaggtcggcggtgagcgcaactgggactaccggtacacctgggtgcgggacggctccctgtcggtgcgggcgctgctcgacctcggcttcgtcgaggaggcggcccgcttcacgcgctggctgggcgaccgtctgagcgcccgcgaagggccggacgacgaacccctccagatcatgtaccgggtggacggcgaccctcatctgacggaggagatcctggagcacttcgagggctaccgcggctcctacccggtccgggccggcaacgccgcctccgaccagcttcagctcgacatctacggcgaggctctctatgccctggccgagggccgcgagatcggcgaacagacgggctatcacgggtggaaggccctggccggcaccctggactggctcgtggactcctgggaccggcccgacgagggcatctgggagacccggggcggacgccaggacttcacctacagccgggtgatgtgctgggccgccttcgaccgcggcctgaggctggccgccacgttccgcaggccggccgacaccgtgcgctggacccaggcccgggacgccatcctcgaacaggtcatggagcgcggctggaacgacaaggagcaggccctggtccagcattacggcggcgacgtcctggacgcctccctgctgctcgccccccgggtcggcttcatcgccccccggagccccggctggctcaacaccctcgacgccatggaccgcgtcctcgtctccgacagcctcgtctaccgctacgacccgcaggcctcccccgacggactgcgcggctccgaagggacgttcagcctgtgcacgttcctgtacgtcgacgctctcgcccgcgcggggcgcctcccccaggcccgctacaccttcgagaagatgcagacgtacgcgaaccacgtcggcctgttcgccgaggagatcggcccgagcggggagcagctcggcaacttcccccaggccttcacccatctctccctcatcatggccgcgacgaccctggacgaggcgctcgacgggccccaccactgaactccggtggcgcgggcatcagaacaaggcggcaccccgctcgaagtccagcagccgccgcttgcgctccaggccgcctccgtagcccgtgaggctgccgtcggcgcccaccacacggtgacaggggacgatgatgccgagcgggttcttgccgttggccagacccaccgcgcgcgatgccttcggattgccgagggcgccggcgagttcgccgtacgagcgggtctcgccgtaggggatgcggcgcagttgctcccacacggtgcgctggaacggcgtgccgtccaggcggagcggcaggtcgaactccgtcaactcgcccgcgaaataggcggtcagctggtcgaccgtctcgccgaacggcgtgtcgtcgcgtgccccgaatgtctcctctgaggggcggtggcgctgggcgaccatgtagaggccgcacaggacgccgtccgccgcgacgagggtgagggggccgtacgggctgtcgacgagcatgtgctgtttcactggatgtcctcacaccggcaggaagttgatcgggtggctgtccgtcgcccacaggtactggaccgcgtacgcccgccacggccgccaggccgccgcgcgtgcggtgagcgcggccggtgtggacggcaggcccaactcctcggccgcgcgccggattccgaggtcggtgggcaggaacgcgtcggggtcgccgagggcgcgcatcgcgatgacgtccgcggtccaggggccgaagccggggagggacaggagccgggcgcgggtctcctcccagtcgctctccacgcccagatgaagtccgccctcggccagttggcggaccagcgtggtgaaggtggtgcggcgggtacggggcatcgcgagcgactcgggggcgacggcggccagcgcctcgggggccgggaagaggtgggtgaggcccccctcggggtcggtcaccgcttcgccgtgcgcggtgaccaggcgggccgcgtgggtacgggccgcggccgtggacacctgctggcccagcacggcccgtaccgcgaactcggcctcgtcgacggtacgcggcacccgccgccccggcgccttgtcgacgagcggggcgagcagcgggtcggcgcgcaactggtcgtcgatggcgaccgggtcggcgtccaggtcgagcatgcggcggcagcggctgatggcgacgggcaggtcgcgcaggtcgctgagggagaggcggcaccctatgtggtcggcggcgggggtcagggcgacgatcccgtgcccgtacggcaggcgcagggtgcgccggtacgcgccgtcccgccattcctccactccgggtacggcggtcgccgcgaggtggccgaagaggttgtcggggttgagcggggcgcggaaggggaggcggagcgtgagagcgccgggggacacgaccgtcttcttcgggagcctgccgcgcagctcgctcggggagagggcgaagacctcgcgcacggtgtcgttgaaggtgcggatcgaggagaagcccgccgcgaaggcgatctccgccatggggaggctggtcgtctcgatgagcaggcgggcggtctgggcgcgctgggcccgggcgagcgcgagcgggcccgcgccgagttcggcgaggagctggcgttcgatctggcgggtgctgtagccgagccgggtggcgaggccgggcacgccctcgcggtccaccacgccgtcgccgatcaggcgcatggcgcgggcgacgaggtcggcgcgctggttccactcgggcgagccggggctggtgtccgggcggcagcgtttgcaggcccggaaaccggcctgctggcaggccgccgcgctcgggtagaacgtcatgttcgccggcttcggcggcaccaccgggcagctcggacggcagtagatcctcgtggtcaggaccgccgtgaagaaccacccgtcgaaccgcgcgtccttggaccggacggcgcgcacgcagcgctcactgtcgatgtgcatcccgttccgcatgcctcaagcatcgaccaccgccgggggcggggctggcgggattccgacatgtacgtggcgtggcctggccccggacggcgcgccttgcggtcggcacgcggactcgcgcggcggccgcggcccgtggaggccggccagggccgtggccggccctcatccgcccggccgccctcgccgcgggcggtggccgcagcgcggcggcgtggcggccgtcgcgcgcgcgtacggccccgggaccgcgtccggtcagatgtcgcgctgctccaggggccgtacggcggggccctggaggatctggccgtcgggggcgaagcgggagccgtggcaggggcattcccaggcccgttcggctcggttgaaggccacgaggcagcccaggtgcgtgcagcgcgcggagacggcgtgcacctgtccgtcgtcgtcgcggtacaccgcgcagcgctctccgcccgcgtgcacgacggcgccgtcccccggggcgatgccggtcaccgacgggccggacagcgggggcagccggtcgcccacgaagtgccctgccacctgggcctggtgcttgaggaactccgtgccttcccgcacgacggaggccacgcgccccggatcgtacagatcacgccatggagccgtcccaccggtgatcagctcgcccagcaggccgcccgccatgatgccgccgctcagcccccagccgccgaagccggtggccacgtaggtgtggcggctgccggggtggagtggcccgaccagcggcacggagtcggtggagtcgttgtcctgcgtggcccaccggtgcgtgaacgtgaggtcgccgaagtgccgggcggcccactcggcaaggcgctcgaaccgctcctcgacgtcgtcgcccgcacccggcgtgaagtgctcgccggtcacgatgagcagccgttttccctcaccgtacggcgccgtgcgcatggaacgcgtgttctcctccggggtgatgtacataccccgcggggccctctcctcggcgatgggcgcggccacgaccagttcgcggcggggtgagagccgggtgaacagcagcgcacggtcgaagaccgggtagtgcgtggcgaccacgacggcgtcggcggtgatcctggcgccgttctccgtcgtgaggacgcagggctccccctcggtgaggtccacgacccgggtccgctcgtgcatcagtcctccgcgccggcggatctcgtcggccagcgccagcaggtacttgcgcggatggaactgggcctggcccgtgacccggaccgcgccggcgaccgggaacggcagctccgtctccgtcacgtactcggcgggcagcccggcctcgcgggccgccgcggcctccgcgcgtacctcgtccgcgcgggcgccgtccctgacgtaggtgtacgccgccgcctcctcccactcgcagtcgatgccgagttcgtccacgatctcggcggcgcgccggatcgcgtccgtctgggagcgcgcgtacagccgcgcggcgtccgtcccgcgggtacggcggagccggtcgtagacaagggtgtgcagcgcggtgagcttggccgtggtgtgaccggtgaccccggcggcgatccgcccggcctccagcaccgcgacgctgcgtccccgtcgggtcagctcccacgcggcactcagtccggcgatgcccgcaccgaccacggcgacatcgaccgtcgtgtcaccggccggtacgggcgcgggggcaccgggcggcgcggtctcgagccagtacgacgtctgtgtgcgtgcctgaagggtcatgcgctccgagttccacgcccgcccgcgcccacaccgggtgtgaaggaacagccgaaggggactcgatcggtccgcgcccagccgcgcgcccccggcaatcgacacccaggggcaccaacccgtcggccggcaaggagaaaccgtgccatcagcacccatcgacggaggggccgatgcgtactccaccgaccgacccgacaccgccccggcccacccccgcgccgggaccgacggacccgcagcccggcccggcgccgggccccgtgcccgcccccgggcccgatcccgtgccaccggcaccgccggcgccaccgggccccgatcccgtaccgccggcgggttcgtcggccgcggtggcagcgagttcggcgaaccgccgatgaagccggcttccgtcccggcccaggcctcgggctgagccccgggccctcgtcgaccggctgcgcgacgcgctgacagggcgcggcaagaaggactgacgctcgcggcggcggcccgttcggacgcgagtggtccggaggccgctgtctgctccgcggcggcggagccccgcgccccggccgccgcaccacgcctgttgccatcgagccgacctggtcgcgggccgtggacgggcgccgtacccgctccggagcaagcacgcccgccgtcatgaactgcgcagtctcctccagacggccttggccgcgttgtggcccgacataccgtgcacgccgggtcccggcggggtggccgaggagcagatgaagacggccgggtggggggtgctgtacgggaagagggagagcctagggcgcagcaggagctggagtccggatgcggcgccgcaggcgatgtcaccgccgacgtagttggcgttgtgggcggcgagttcgggcgggccggccgtggcgcgggcgaggacacggtcacggaagccgggcgcgaaccgctccagctggcgctccatggcatccgtgaggtcgcccgtccacccgttcggaacgtggccgtacgcccagaagacctgctttccgtccggcgcccgcgaggggtcgacgacgctgggctgcacggtgatcaggaagggcgggtcgggagcccggccctcgcgcgaggcggcgcgcagggcggtgccgatctccgcgctgctcgcgccgatctgcacggtgccggcggtgcgcgcctccttcgccgtccacggcacggggccgtccagcgcgtagtcgatcttgaatacgcttgccccgtaccggtatccctcgtagtacctgccgaagccggcgatccgggccagcgcggtgggcgaggtgtcgaagacgtaggcccgcgcgggcggcaggtcgtcgaggcgcttgacctcgtagtccgtgtggacggtgccgccgaggtccttgaggtacgcggtgagcgcgtcggagatggactgggagccgccgcgggcgacgggccagccgcgggcgtgtgcggccagggcgaagacgaggccgacggctccggtggcgatgccgtcgagcggggcgatgacatgcgccacgagcccggcgaacagcgccttcgcgcgctcgtcgcgaaagcggcgggtcagccaggtcgaggggggcagcccgacgaggccgaagcgggcgagggtgaccgggtcgcggggcagcgcggtgagggggagcgacatgaagtcctgcgccagggtgtcccagcggctgaggaagggctccaccagcctgcggtacgtgcccgcgtcacgcggcccgaaggaggcggccgtctcggccacggaccgggacaggaccgctgccgtgccgtcggtgaacgggtgcgccatgggccgctcggcgtgcagccactgaagtccgtaccgctccagcggcatcgccctgaacgcgggcgagttgatccccagcgggtgtgcggcggagcacgggtcgtggcggaaaccgggcagggtcagctcttgggtgcgcgccccgccgcccacggtgtcgcgggcctcgaagacggccacggagaagccgcggcgcgccagctccacggcagccgtcagtccgttcggtcccgcacccaccacgaccacatcgagcatcgacggcaccttcggactccttcgtcagccgatcggccactggggatcaggatatgccgctggaccgacagcgccggggcgcggggggcccttgcccggtgacgcacaggttccgtttccgggtgccggaggaggctgcctggaggggcccgccgaccgcgcgtctcacggctcagccgccggccgacagcagccccaccacccggcgggccgtcgcctcgtcccgcgccgccgtgaacgggagcgcgttgccgccggttatccggaacggctcgcccgcgcgggtcagatgggcgccgcccgcctcctcgaccagcagcaggccggccgcgtgatcccaggccgcctcccaggagaacgccgtcgcgtccaactcgccccgggcgacggcgagatactcgagccccgccgagccgcacgggcgcgggaggacgccctcggtgcgcagggcgaggagtgcgcgcttctgttcttccgtggtgtagtccgggtgggacgtggccacttcgaggtcacggcccggatcgggcgcgcccgagcgcagcggttcgccgtcgaggtgggccccgcggccccgtatcgccgtggccaactggtcgagggccggggcgtaggtccacgacgcgtggacgacgccgccctgcgccagcgcgaccagtgtgcagaagcccgggtcaccgtgcacgaactggcgggtgccgtcgaccgggtcgacgatccagaccggcgcctcgccctgaatcgcctcgtatgtcacggggttggcgtgcaccgcctcctcgccgaccacgaccgagccgggcaggagcttggcgagcacctcggtgaggtacgcctcggccttgcggtcggcgtccgtgaccaggtcgtgcgggccgctcttctggtcgatctcgtgcgcggcgagctgccggaagcgcggcatgatctcggtcgcggccgcctggcggaccgcctcttcgacgtctgacgtgcggtgggcgagaaactcttcgatggtttcggtgtctccgatcatgactccatgacagcacgcgccactgacaatccccacccgtccggtgtactacgggtggaatcggcatgaatacccggttcggagatcagcgcccgaccgcgtacccctgcatcccccgcgggttcgccgccgccgacaggacaccggtctccgggtcccgggcgaccgcgcacagccgcccctcggaccaggcctcgccgaccaggacgtcgtggccgcgccgccgcagctcctcgacgaccccggggtccgtacgggactcgacggtcacactgccggggcgcgtcccgcgcgggtagaaggagccggggaagctgtcgttgtgccagttcggggcgtcgatggcgccctggaggtcgaggccgccccggaccccggagcgcaggacgacggccaggaagaagtgggtctgccactggtcctgctggtcgccgccgggcgtgccgaacgcgagcacggggacttggtcccgcaacgccagcgagggcgtgagggtggtgcgggggcggcggcccggggtgagggagttcggcaggccctcgtccagccaggccatctggagccgggtaccgagcggaaagccgagttcgggcacgaccgggttggactggagccagccgccgctgggcgtggccgcgatcatgttgccccacctgtcgacgacgtcgaggtggcaggtgtcgccccgggtgcccccgtccgccgcgatgtccggttccccgggcaccggggacagcgggctcttggcgacggtgggctcgcccgctcccgggggaccgaacgcgggctcgggttcgtcggcggccaccacgcgtgcgtgcccgctcatccgcggggtccgcccgcccgggctgccggggcgcagctcgtacgaggccttgtggccgacgagcacccgccgctcggcgttgtacgcgtccgacagcagctcggccagcggcacctcggccgcgtcgccgtaccaggcctcacggtcggccatggcgagcttgcagccctcgatgaggaggtggacgtagtcggcggacccatagcgcggcagctcgggcgggagcagcgcgagctgctggaggaggaccgggccctggctccaggggccggccttgcacagcgtccagccctgccagtcgtacgtcgccggagcctcgtaggtcgcggcccaggaggcgagatcggcggccgtcagcgtgccggtgtgccgctcgccgctggtgtccagggtgggccgcccggactggcgtacgagcgcctcggcgatgaacccgccacgccacacctcccgtgccctctcgatctgggccacccggtctccggtgcccgacacctcggcgatcagccgtttccaggtcgcggcgagcgccgggttgcggaacagttcacccggccgtggcgcctttccgccgggcagatacacctcggccgacgagacccactccgtctcgaacagctcgcgcaccgtctcgacggtctccccgacgcgctccacgggcgcgtgcccgtcctgcgcgtatccgatggcgtacttgaggacgtccgcgagggacttcgttccgtagtcgcgcaggaggagcatccaggcgtcgaacgcacccggaacggcggccgcgagcggccccgtaccgggtacgagatccagaccgagtcccttgtagtgctcgatcgtggctccggccggcgcgactccctgcccgcacagcacccgcacctcaccgcccgccggggcgaggatgatcggcacctctcccccgggcccgttgaggtgcggctcgacgacatgcaggacgaaaccggcggcgacggcggcgtcgtaggcgttgccgccctcctccaggacggccatcgccgactgggaggcgagccagtgcgtggaggacaccatgccgaaggtgccctggagggtggggcgggtcgtgaacatacggcctctcacctcgctgtttccgctcatcggccagatcggtcggcgctcaggatcggccctggggggaatctggggagttcgagtcacacgcgagagatccaatcacggcaccgaagcccacgcgggcacgcttcagaccccctgctcacggacgcgtacggcacccacgcgagaggcccggagaatccgcacaaaagcgccacacagactgcactcaggctttcgaaagcctcgttagcgttgctggctgctcgattccacgtgcgaacgtgaccaggccccggcggggcgacggcatgtcaactcaggaagaccgcaaatggactactgctcctcgtgtcgccggcatctcaatggcgccctggtgtgtcccgggtgcggtgcctacgctccggacatcgcaccggccaccgtcgacggtggcgtcgtcccgagctgggccggcacggcgacgacgggcacgacggtgagcgagtcggtgccgtgggagtacccggcctcggacacgtggcacgacggccgtcttcgtgacgaggcagcggtcgaagccggcctggaggaggccccggagaccgacccgtacggcgacctcgagggcacgatgcccgcacccgcaccgcaagggcgggcggcgcggcgtcgccagctggcccgctggaagaagaaccagcgccgggccgtggtcgcgactgccgtcgcactcgtcggaggcggcctgaccgtcgccgcgatggaccggcactccgccgaccgggcacaggcgtccaccgcgccggaggtcgcgaccatgggcaccgcggacgaacaggtggctgagcagccccacccctcgtcgacacaacccggaactcgcctgtcttcgcacactccccccgcgcagtcgcccacgaccgaccttccgcgccggcggtccgccgccgccccgccccgcgtcacaccgccgagcgctcagccgttcgccgccgcctctccccctccgacggcgagggcggcggccccgcagcctcggaccgcctccccgtccaccgtcggaacggtgcccgacggcaccggtacggcggcgaaggaaacgtccgcgtctgccggcgccgatgacacggccccgggagcaccgcaggcgagccccgcgcccacaacgacttcaccttcgcagatctgcctgctcctggtgtgcctcggctgatcggccgttcaacgtcagcgagtgcggacggagcctgcggggaccggggagttctctcagtacccgctcgggcttctcagagcttcccgccgatctcgcaggcccggcacggcggccggccgcaggtgcactgcgtgatggcgtcgaggacgtcgcgatcgtggtagaggcactcgtccttgcaggtgtggcgcgggatgaatcccgccgggatctcaccgggccacggctcgtgaccgtcccggcagcgggcgaaccgctcggggtcggtggagtgcaggtcgtgcatgctcgaccgcgcctcgtcctccagttcccgcactcgctgcaccaggctcttcagctcggtggcaatgctggagtaccggtcggcgccggtccttacgtgtgcggcccgcagtgccatcgccgcgttgcccaaaaaacggccggcatcctgaaggtcggtcacgtgatgcaactgaatgccgttcacgccccgtacccacacggcgtccatgctgctcactgatccacctttccagcgttcgccttgattaccttgcgaaacagtatgcgcggcgccggtgcctccgcatagaaaaactgtctattcagcaagctaagggtctccgtcgcgccccgccagcagattccgggtgagtcggctcacagaagacatgggcccgcaacaggcatgaccagcagaaggtccattgctcactcacgtggtggatcttcagccgcgtcttccaatggatcttctgctgatttcttgtccgccctctgttattgagccgccgttccggctcaatatgcgttatccggtgaccgtgtaggagcgcgctcccgttccggctagcccaccaccgtcgacgatcaggtactccggacggatggggcgcccgtcgaaccagcactccaggatctcccgggtaccggcggcgtagcgggcctgcgccgagagggtcgaaccggacacgtgcggcgtcatcgcctcgtacggcatggtgcgccacggatggtcgggcggtggcggctgcggataccagacgtcaccggcgtatccggccagttggccgctgttgagggcccgcaccacggcatcccggtcgacgatgagcgcgcgtgcggtgttgacgatgtacgaaccgcgcttcatggccccgatcaggtcgtcgtcgaagaggttctgcgtctgcggatgcagcggggtgtggatcgacagcacgtcgaccgaggaggccagcgaacgagcgtcgggatgccaggtcagctccagttcctcttcgacctccttgggcagccggtgcacgtcgctgtagtgcagccttacgtcgaacggcgccaggcggcgcagtaccgcctggccgatccggccggagccgaggacgccgacgtccatgccttcgaggtcgtaggcgcgcgagacgctgtcggcgatgttccagcccttcttggcggtcacccagtcgtgggccggcatgtagttgtggaccagagtgaggatctgcatgacggcgtgctcggacacgctgatgctgttgctgaaggtcacctccgccaccgtcatgccgtgggcgatggcgctcggcaggtcgacgtggtccgacccgatccccgccgtgatcgcgagtttgagccggggcgcggaggcgatccgctcggcggtcagataagcgggccagaagggctgcgagatgaccacgtccgcgtcgggcagctcgcggtccagagtggagtccggcgcttccttgtcgctggtgacgacataggtgtcgcctcggtcctccaggaaccggcgtagtcccagttctccggagacgctgccgaggagctgccccggggtgaaatctatggtttgtggggtcggcgttgtctgaccgcccggatatccggtgatggccggaatctcatcgcgggcgtagtcgggaggataaccgcccacggggtcgggatagagcaccgcaaggatctttgccatggccgtcctccatcggtggggccgccgctccggctgaaccggtcgagtaccgatgatcttgaattttagttgagcatgcgtcggcgctgcaatccccacggatattatggaagtgggccagtggataaggatgcggatattcgatcaggcctgcggcaggagttcgggcgacagcgtgtaccgatccgtgttctgtacggaggcttctgatgcgggcggacgaatccgggcccgagcgggaatcccgagagcccacgcacatccccggcgccgaacccgaactgggtggcgagcccacgccgcgaggcgagcccgggccgggattcgagcccgggccgggaggcgagcccgcaccgtcacgcgcgccgttccgctcacgtctgcgcaagggcgtcctggcggcggtcgcgctcggcggcgttctgggcgggtcggcccgctacgccctgggactgacgtttcccacacctcgggggacgtttccggtgacgacgtttgccgtcaacgtgtccggtgcgttcctactggcgctgctgctcgtgtacgtactcgagatctggccgccgacccggtacgtgcgaccgttcgccgccgtcgggtttctcggctccttcaccactttctcgacgtggatggtcgacaccgatcgccttctgggtcacggccactacgcagtcgcggccttcaacgtgttcggcagtctgttcgccggcctggccgccaccggtctgggcctggccatcggcaggatggccctggcccggcgggtacggctggccgcgcggcacggccgcgcccgccggtacggctggtgggtccggtgatcgtcaccctgctcgccgtcggtgccgcggccgcggtcggggcggtcgcgcgctacatgctcgaccagtacgtgcagtaccgaagcccgggcctgttcccgctcggcacatggctgatcaacgtcaccggttcgttcgtgctggggcttctggtgggcctcggcgcgcggcacggactgccggagcagttcgtgcccattgccggcgtcggattctgcggcgcctatacaacgttctccacattcagttacgagttggtccacctgcgcgagaagggacaggtcagaaagtccctgctgtacggcgcttcgagcctcacggcgggtcttctggcggcagcggcggggctcgccgtcgaatcgttctgagaatcgaatcgctccgggaatcgaatcgctccgggaagggcaggaccagccgtcggggacttgacacgtggattcacgagacgtctccttgaacgtaggaaacattatgtggcgtacgcctctccggacacgccgcacgcgatcgggttggccagcgtccaccgaaatccggaggctgctgatggcaacctatgaatatctatgcagccgctgcggggccttcgatgtgaagttggaaatcgggacggcgccccgggcttacggttgccctgtttgcgcaggcgctgcgagacgtgtgtattcctcgcccggtctctcgctgacctcgcacgcggtcgccgccctccacgtccgggaggagcaggcgcgtgaggccccggcagtagtctcccaagtgccgccacgcagaagggtgccacggcacccgcaccccgcgctctcgcggcttccgcgtctctgagggcggtggtcgacaaggcagaacgtctcatgcgggtttcggcatcggaacacgacgtcgttcccgcagcgctgtgcggaatacggaatcacgcaacgcgggccgggagtcgagccgcatccccggcagctcaccggcagtccgggcacgacgcgattccgccccccacgcggacttaggaggtgcgtccccgtgggaaacgtgggactgctctttgtcggtgcggtgctcttcatgaacggactgctgctgctcgggaaggttgatgccaaagcagcagcggtgttcaaccttttcataggcgcactacaggtactgacgccgacttacctcatcttcaccgccaacggcgaccccatgaagatcctggcggcatcaggcatctacctcttcgggttcacctacctctatgtaggtatcggcctgctcaccggtctcgacagcaccggcgtcggctactactcgctgttcgtggcagttgccgccctgggatactcgttcgtcaatttccggctcttcaaggactaccccttcggggtcatctggctctactgggcctacctgtggttcctgttcttcctgctgctcggtctcaagaaggacgacctcaagatctataccggttgggtcacggcgatcgaaggctgggtcacgggtgcgattcccgcggggctgctgctctccggctactggaagcaccccaccgagaccgccatcgcactggcggtcttcggcgtggtggtgttcgtggggctgtggccgcgcacccatagaacgccccggccgacctcagccgccccgcggaccggaggtgtgggcgcaccaacgtgaccggatcagaaacgaggagttctcatgcctgaaattctcttcagtgtggaccacagcaagtcgatgcgtgaccaggccgtgcccggccacaacaggtggcacccggacgtccccaccgtcgccatggtgaagccaggagcggagttccgcatggagtgccgcgactggaccgactgccaggtcggcaacaacgacaccgccaacgacgtacgcgacatcgacctgaccatccctcacatgctcagcggcccgataggcgtggagggcgccgaacccggcgacctgctcgtcgtcgacatcctcgacctcggccccgttccgcagcagaccggggacgcggcaggacagggctggggctataccggcatcttcgccaaggccaacggcggaggcttcctgaccgactacttcccggacgcctacaaggccgtatgggacttccacggacagcaggccgtctcccgccaccttcccgggatccgcttcaccggaatcacccaccccgggttgttcggaaccgctccgtccgccgagatgctcgcccgctggaacacccgcgagcaggcgctgatcgacaccgacccgaaccgggtccccccgctcgccgtaccgccggacgccaccaacgcactcgccggcacggccaccggagacctcgcacggcgcatcggcgaagaaggcgcacgcacggtgccggcccgcgagaacggaggcaaccacgacatcaagaacttcacccggggatcgagggtcttctaccccgtacacgtccaggacgcgaagctctcaggcggcgacctgcacttcagccagggcgacggagagatcaccttctgcggcgccatcgagatgggcggcttcatcgacttccacgtcgacctgatcaagggcggcatggagacgtacggcatctccaccaaccccgtgttcattccgggcaacgtcgagccgaggtacacggagttcctcaccttcatcgggatctccgtcgaccacgacacggacacgaactactacctggacgcgacgctggcctaccgccgggcctgcctcaacgccgtcgagtacttcaagaagttcggctacagcggagagcaggcctacctgctgctcggctcctcccccatagagggacgcatcagcggcatcgtcgacatccccaacgcctgctgctcgctgtacgtacccaccgccatgttcgacttcgacgtgcggccgaccgccgccggcccgatgaaggccgaccgcggccagtgcgcgctggccactgcctgaaccggaccacgagggatgcgtgccctcaggcaagagcgacgggcccaggggcgtcaccggaacaccggtgacgcccctggagcgtccgccggcagggcctaggaggcaggtgcccacgccgtcgtcccgagcgtgttctccgggccgatgtcgagcggctcttgaggacgtacgttcatggcgtcccgccccgtcttcggcgcgacccggaggtacgtgccgtcctcggctcccatccgccagtagagacctgcccgcgcggtctcgcccggcgcgagcgtcagcggctcggggccggggtcctgcggcgccatgaacaccttgtccgtcccctcgacggtgcgcacgcccgtgagcggggtgcccctctcgtcgaggacgcgcacggacgggtagccgttcacctcgtaggaccgcttgccgcagttggtcagggtgagcgtcatggcgcgcagtcccatggccgcgtcgacggggccggagtcgaagcgcagaccggagggcgggcagccgcgttcctgctggaccggtacgacgggtgagggcccgggggtcgcggacgcgggcggcggggcggcccgggtcggcgacggggcggcccgcgtcggcgatggggtgggcctgcgttcggggttgcgctcgcggtccagttcggcggagagtccgcacccgctcgcggccagcgccaacagacaggcgagagcggcgcagcgggccggcttcgggcgtatcgcgatcacgcgccgatgatggcacgcggtctcggcacaaggcgtcactccgctcgccccgcgccgccaccaggcccgactcgcgggagaacagcaccagttgggcccggccacaggcgcgcccggcttcgtcgtcgcgttcgtcgtcgcgcggctgatgcgggtctcggccgtgaaggggctgatgcccccggtgcgcggcgatctcctcgccggtgaggccgcccccggcaagcgcggtgacctcgcgttcgtcacgaacatcgcgtacgcactggagacggatcacggcgtccggctccgggccgcggtgcggcccgtgacggcggggcagcccacagcccgtcaacagggagccactgtgaccgcacaggtacggagcgagttggcccttccgccccacagatactcgtgtgacactggcgtcccgtccgcagtgcggactctctccgcaccatcccccacgagaagtgcgccgtgtcttcgctgcctctgccgctcgccctcaccgcacgtctgctgccggtcgccgtactcgcctcggccggctgggccctgacgtcgggtccgttcgccccggcaccgaccgcccagcacaagccgacacaaaagacacagacccagagccccaccgcaccctcgacaacggcggccaccaagacgtacgcctcggccccggcaccgtgcggcgccgtgccggagaagacggtgacctccctggtccccggcaccaagaccgcgggcaaggagatcgcgtcgaccgacaagtcggtccgccgcacctgctcctggaatgcgctcaaggggtacgactaccgctggctcgacgtctcctacgagatatcggacacggacaaagcggcacagaagaccttcgagcagcgcactacggagaagagcggcggaggggcggtccccggactcggcgacgagggctactccgtcgtgaacctcaccacggaggacaagcagcagacgcgcgagggtgtggtgatggctcgcgtgtccaacgcgctggtgaccgtcacgtacaacggcagcgacttcgagacgcagaaggcgcccggtacggacgagatcaacaagggtgccatcaaggccgcgaaggccgcggtggcagcgctggaggacgggcagaaagcctgaccgtcctccgtgcgctccgtaccgttgcgtcagaccgcggtgcgtcagaccgcggtgcgtcagaccgcggccttgtcccgtccgcgcagcgccatcagcaccacgtacaggaccgtcgaggtgccgaggcccaccgcccagccgtagtcggccagcgactggagcgccggtatgggccggccgtcgatcaggggatggaagtcggcacctccgacggccagcacaccgccgaccacgaaggcgacgacggcccgccagttccagccgccgtcgtaccagtagcggccgcccgcgcggtacaggtcggcgaggtcgagggagccgcggcgcaggatccagtagtcggcgatgagaatgccggcgaccgtgccgagcagaccgccgaccaggcccagccaggtgaagatgtagccctgcgggtccgagtacagcttccacgggaagatcagcacacccagcacacaggtggcgagcgcaccggtgcggaaactgatcttgcggggcgcgatattggagaagtcgaaggccggtgagaccaggttggccgcgatgttcacggacagggtcgccaccagcacggtgaccagcgcgaagatgatgccgaagacgttgtcggtcttggcggcgagctgtaccgggtcccagaccgcctcgccgtacaccacctgggagccggaggtgaccatgacggacaggaacgcgaacaacgtcatggtggtgggcagaccgagcgcctgtccccaggtctgggccttctgactcctgccgtaccgggtgaagtcggggatgttcagcgacagcgtggaccagaagccgatcatgcccatgagcgacggcgcgaacagcttccagaagtccgggccccagccgagcttggagggctggtcgaggagcgggccgaagccgccggccttgctgctcatccaccacagcatcacaccggcgccgacgaggacgaagggcgccgcccagttctcgaagcggcggatcgtctccatgccccggtagatgatggcgacctggagcacccagaagatcgcgaacgacagccacatggtccaggcgtagccgccgaccttcgaggcgttcgcccagctgtcgccgaagagcttcccggcgaggaagtagatcgcctcgccgccgatccaggtctggatgccgaaccagccgcacgccaccaacgcccgtacgacagcgggcaggttggcgccgcggatgccgaaggaggcgcgggcgaagacggggaagggtatgccgtacttgggtcccgcatgcccggtgagcagcatcgggaccagcacgatcaggttggccagcgcgatggtgagcacggcctgcttccagtccatgccgacggctatcagaccggaggcgagggtccaggaagcggtgttgtgggccatgccgacccacagggcggagaagttgtacgtggtccaggtgcgcttttcgaccgggaccggaagcaggtcctcgttggcgtaggggccgctgggggcgggcgcgtccggggcgatctccacccgtccgtcgggcagggtgacttgggcggtgggcgggctgtccggagggacggtctcggtcatgggcaggccaatcaatgaggcgggacgggaaaggccgtgcgggtggcgcttggggggggtgcgcggagagcgccctgtccccttcccgggcggcgggaaggggacgatccgaggagcgggccaacggccctgtcaatgccgacagttgacgtttaccggcggcagttgccgttactgcgggccgttgacggccgggatgatcttcgtcccgtaggcgtcgatgacggcttcctgcgcgtcgtgcatgtcgtagacggcgaactggtcgacgcccagctcacgcagggcgttcagcttctcgatgtgctgctcgaccgtgccgatcaggcagaaccggtcgacgatctcgtccggcacgaacgcggtgtcggggttgtcggtacgcccgtggtgggagtagtcgtagccctcgcgggccttgatgtagtcggtgagttcgtcgggtacggcggcggagtgctcgccgtacttggagacgagatcggcgacatggttgccgaccatcccgccgaaccaacggcactgctcgcgcgcgtgggcgagcgcctcgggcgagtcgtccgccgtgacgtacgccggcgcggcgacgcagatcctgacctcggacgggtcgcgcccggccgccacggccgcgtccttgacggccttgaccatgtactccgtcagatagaggtcggccagctggaggatgaacccgtccgcctcctcgccggtcatcttcagggccttcgggccgtaagcggccatccagaccgggagttcggcgcccggcttgacccacgggaacttgacgaccgtaccgccgaggtcggcctcatcgccgcggccgagggcacggatcaccttcatggcaccgcttatacgggcgagggtgttgggcttgcgcccggcgacgcgcatcgcggagtcgccacggccgatgccgcacaccgtgcggttgccgaacatgtcgttcagcgtcgcgaaggtggaggcggtgacctcccaggtgcgggtgcccgggttcgtcaccatggggccgaccgtcaacttctgcgtgttggcgagaatctgactgtagatcacgaacggttcctgccacagcacggccgagtcgaaagtccagccgtagcggaagccgttgcgttcggcccgcttcatcaggctgatgacacgcgaggccggcgggtcggtctgcaggacgagtccgaagtccatgtgcgccactcctagttcaggtactgacaggtggagcggggggtgtagacgccatgccccgcgcgcccggtgaactcccgctcggtgatgaccggttcgccccgcgagagcacggtctcgacccgtcccgtgacgcgcctgccctcgtacgccgagtagtcgacgttcatgtggtgcgtctcggccgagatgatctgctcggcgtgcgggtcgtagatgacgacatcggcgtcggcgcccggcgcgatggtccccttcttcgggtacaggccgaacatccgggccggggtggcgcaggcgatctcgatccagcggcggcgcgagatgtgcccgtcgacgacggcctggtggagcaggtccatacggttctcgacccccggcagaccgttggggatcttggagaagtcgccccggccgagctccttctggccgacgaagcagaaggggcagtggtcggtggagacgacctggaggtcgttggtgcgcaacccgcgccacaacgcggcctggtgctgtttggggcgaagaggcgtgctgcacacgtacttggcgccctcgaagtcgggctcggcgaggttgtcggtcgacaggaacaggtactgcggacaggtctcgccgaagacgttcagtccctcgtcgcgcgcccgtgccagctcggcgaccgcttcctgcgccgagacgtgcacgacgtacagcggagcgcccgcgacctgcgcgagcttgatggcgcggtgggtggcctcggcctccagcagggccttgcggacctcgccgtgataccgggggtcggtctcaccgcgggccagcgcctgctcgaccagcacgtcgatcgcgatgccgttctcggcgtgcatcatgatcaggccgccgttctcggcggagcgctgcatggcgcgcaggatctggccgtcgtcgctgtagaagacgccgggataggccatgaactgcttgaaggaggtgacgccctcctcgacgaggaggtccatctccttcagcgtctcgttgttgacgtccgagacgatcatgtggaaggcgtagtcgatggcgcacttgccatcggccttggcgttccaggcgtccaggccctcgcgcagcgaatggcccacgctctgcaccgcgaagtcgacgatcgtcgtcgtaccgccccaggccgcggcccgcgtacccgtctcgaaggagtcggaggcgaaggtgccgccgaagggcagttccatgtgggtgtgggcgtcgactccgcccggaatcacgtactttccggtggcgtcgatggtccgctcggccgtccaggcctcggcggccggggtgcccgaggcggcgagggcgacgatgcggccgtcctcgatcaggacgtcggcgtggatctcgtcggacgcggtgacgacgaggccaccgcggatgacggtacggctcatgctccctctcctactcctaccgtggtcagcactgctgtctggtgcggcggtcggtcccgccggtccggccgcccgtgcaccggaccggcgaacgcccggccggctacggagcggtcaggggcccgtacgcgcccggggcgcggtcgcggtagaactgccagcggtcgcgcacttcccgcagcttggccaggtccaggtcgcggacgacgagttcggtctccttgtcgctcgccacctcgccgacgaactgcgcctccgggtccacgaagtacgaggtcccgtagaagtcgttgtcgcccagctcctcgacgcccacgcggttgatggcgccgacgaagtactcgttggcgaccgccgccgccggctgctccagctgccagaggtagccggacagaccgcgcgaggtggccgacgggttgaacacgatctcggcgcccgccaggcccagcgcccgccagccctccgggaagtgacggtcgtagcagatgtagacaccgatcctgccgacggcggtgtcgaagaccggccacccgctgttgccggggcggaagtagaacttctcccagaatccctcgacctgcggaatgtgggtcttgcggtacttgcccaggtacgagccgtcggcgtcgatcacggccgcggtgttgtagaggacgccgggctgctcctcctcgtacatcggcaggaccaggacgatgcccagttccctggccagcgcctggaagcgcttgacgatcgggccgtgcgggatctgctcggcgtactcgtagaacgccttgtcctggacctggcagaagtagggaccgtagaacagctcctggaaacacaggacctgtgcgccctgtgcggccgcgtcgcggaccgcctgctcgtggacctggatcatcgattccttgtcgccggtccatgcggtctggaagacggcggcgcggatcactctgctcatcgggacctccggtcgctcggtgtgcggcgagcctagaaagtcctgggacccggattgagttgcaccgtgtcacgtctgcggacacctggcgttccacggtgtcacccctgtccgaacgcacgtgtttcctgctcttgtccacgccgtttcacccctgttgggcatcgtgtgcgagcagcgcgatgtggacggaggcggcctgttcgaagtcgtcgaggtcgacgccgagccgcgcctggatggcctccagcctgcggtagagcgcgggccggctgacgtggtggagctgcgcggtgcgggacttgttgcggccggtggccagataggtgcgcagtacgggcagcaggtccgactcggcgtcgcgtccgcacagcagcccgttcagctcgcgctcggcgaaggactggacgtacgggtcgtcccgcagcagccggatcagaccgcgcagatggacgtccctcaggcgcaccacggccggcaggtccagcacggccgagttctcggccacggcgtcggccacgtgctgggcctcacgcagcccggcgggcacgtcgtcccaggcggtacgcggatcggcggcggcgaccacggtcccgctcgccccggactccgtacgcagccgggtggcgaagtgcgccgagagtgcctccgcgtcctggtcccgggcgaggctgagcagcacggcggtggctccgtcggccagttcggcgacgagtccgggcagccccagcatgcgcaggacgcggtcgagcacgggcggctccccgtcccgtacgacgagcggcacgaaagtccggcggttgacgggcagtccggcggcccgcgcacgcggcaggagctgacgggccggtacgacaccggagacgaggtccgtcagcaggccctgcgcggactgctcctcccaggtgtgggcggagccgccgagcatccggtgcaggaccagcgcctcggcggcccggtcggcgagcaggcgccccgtggcggcgtcgccgcggtatccgcacagtacgatccggccccagcgctcaccccgcccgcccagctcggcccggacccagccggcgccctcgctgccgcccgcctgacgcgctatgcgctcccagtcacgcaacacgtcgtcgaccgcggaccgctcccccgccgtggcgaggacgcggtgcgcgagattggtgacgacgacgggacaggcggcgtgcccggcgatctcgtcgagcatccgctgcagaggagcgcccgccgtgatgagtccggtgagcgccgtgcgtaccgcctcggacaggctgacggccgcgaacttctgtcgtacgagccgggattggacctcttccgtcaactcggcgaacgggaagggccggtggagcaccaccatgggcagaccgcagcgctccgcggcccggcgcatcacgtccggcggcgccgggaaggcccggccgagtccgaggacgacggccgcggcctccgcgcggtgcagcgagcggatgtactcggcctgcgcctccgggtcgccggccagcagcaccccggtggtgaggaccatctcgccgccggtgagcatcactccgacgtcggcggcctcggcgacgtgcacccagcgcacgggccggtcgaggtgaccggcgccggccaccacctcgggctctccggcgagtacccggtccagggtgaggacctggcgtaccgacagggcgggttccagggcggtggtcatggcgacgttcccttgctcgggcctgctgctcaggtgttacggaagacacctcatggttcagacactcctcagggcgcggtcgaggatcgcggcgccctcttccgcctcggcgacggtgagcgagagcggcggggcgatgcgcagcgcgctggtgttgtgggcgccgcccttgccgagcagcaggcccgcctcacgggcggcttcgagcacggcggacgccgcctgcgggttcgcctcgtcggtgccgggcttgaccagctcgatgccgatcatgagcccgcgcccacgcacctcccgtacgacgggaagctgcgcgccgatggcccgcagccgctcgatgagcaggccgcccacgcgccgggcattgccctggagatcgtgttcgaggaggtagatgaggttggcgaggccggccgccatggtgatctgggtgccgccgaaggtcgaaatggagttggcgtccaggcagttcatgatgtcggcgcgggcgacgacgccaccgatggacatgccgttgccgatgcccttggcgaaggtgaggatgtccggcgggccgctctgcccgtgtgcctgccagccccagaagtgctcgccggtgcggccccagccggtctgcacctcgtcggcgatccacaggatgccctgctcctggagtacctcccggaaggccgcgtacagcccgtcgggcggtgcggtgaagccgccgacgccctggacgggttcggcgatcagggcggcgggcgggcggatgtggccgagcaggtccttcaggtcctccacgcaggccgcgatgaagtcggcgtcgccgagttcggcgtacgggccgcgggtgcggacgccaccgtgcacgtacagcgtctgcaggggtgacagcgaggtgggcgaccagcccttgttgccggtgatgccgaccgcgctgaacgagcggccgtggtagctgttgcgcatcgccaggatctggttgctctgccggtacgtcgtcgccagcagcagcgcggtgtcgttggcctcggtgccggacgtggtgaagaagacccgggcgtccgggatgcccgacaactgggcgatccgctccgcgagttcgaccatcggccggttgaggtagagggtcgaggagtggacgatccgcccggcctgctcgctcaccgccttggtgatctcgggcagcgcgtgcgcggtcatggtggtgaggatgccgccgaagaagtcgagatacctgttgcctgccgcgtcccagacgtggcggccctcgccgtgggtgatctcgatcgggtccgcgtagtagagcgcgagccagtcgggcaggacggaccggtgacgcccgtacaggtcgctcacggccgcaccagcccttcgtaggcgtcggggcggcggtcgcggtagaaggcccactgctgccgcacttcgtcgatgacgtcgaagtcgaggtcacggacgacgagttcctcggacttgtcgctggcgacctcgcccacgaactgcccgcgcgggtcgacgaagtagctcgtcccgtagaagtcgttgtcgccgtactcctcctggccgacgcggttgatcgcggcgatgaagtactcgttggcgacggccgcggcgggctgctccagctgccagaggtaggcggacagaccgcgcgaggtggcggaggggttgtagacgagctgggcgccgttgaggccgagctgccgccagccctccgggaagtgacggtcgtagcagatgtagacgccgaccttgccgaccgcggtgtcgaagacgggccagcccatgttccccggtttgaagtagtacttctcccagaagcccttcacctgggggatgtggtgcttgcggtacttgcccaggtaggtgccgtcggcgtcgatcacggccgcggtgttgaagtagaagccggactgctccacctcgaacacgggcacgacgatcaccatgccggtctcgcgcgcgagctcctgcatacgaaccaccgtgggtccgtccggtaccggctcggcccagcggtagtgctcgggctcctggacctgacagaagtagggggcgttgaagacctcctggaaaccgatcaccttcgcgccctgccgggccgcctcgcgggcgtgctccacatgcttggcgatcatggattcggtgtcaccggtccaggtcgcctggaccagtgcggcgcgtacgacgtgggccatgtgccgctcctttgcctgttgtcctcgcggggacgtcagagagcctctacgcccgtagacacaggcggtagaggctcgaacgtaagcctccgggacggccttgccaagaccatcgtcgttaacccgcggagtcgatcacgtttcgcacccctgtgggtgagtggccggccgtgcggcgcaacccctggtgcctcgcgcgccccaggtgtgtcaggtcgtgaacccggcgacacggagggcgtggacgaggtcccagtggcattcctcggagacgccccgggccgcctccaggagcagggggacgagcgtgtgcgggtccgcctcgacactgcgggccgcttcctccggagtgcggatgcgtacgtacgcgtcgagcagggcgcgggcctcgcggtggcggccgtcgccggtgagcccgagcagggcctcgccgatctccggggcgggccggaccaccccctgccgcagcatctgttgcccgtccaccgtgcggcccgccgcgacgagcgcgtccgcggcggcgaccaggcggtcggcggggagcgaggccgcctcccacaggagggtggcccagtcggcgccgaggccgacgcggtgcagttcggcggcgagcagcgggaagcgggcggcgggccagtacgcggcctcgacgagcagcgcgtgcgcctcaccgctgcggccctcgccgcgcagtcgggtcagtgtgcgcacggtctcgatggtgtcgcggcgcgcctcgtcgtccagcggctcgcgtcggggcttcgccgccggggcctgcccggcggctccggcgaagcgggcgccgcggggggtgcggccggtgttcggtgcgggcgcgggagcgggtgcggcgggcagggtggcggcgggcggtgtctcctgcgcgtcgatcatcccggcgaagcgggcgctgccccgggggcggcgctttccgcgctgcttgggcatggtggccggggctgcggaggtgacgggcggggggttgtcggtggtgtggggcggatcggtgggatcggtgggaccggtgggactgacggggtcggctgggtcagcggggccggtgaggccgtcaaagccggtggaatcagtggaatcagtgggaccggtggaaccggtgggaccggtgggaccggtgaggtctgtgcggccggagaggtcggcgtggccggtcggtccatagccctgctgctgtggacgcagccgccgaggacgactgtcgccggtcccgtccggctcccgctgtccggcctcctgcgcccggaaaacacccccggtcccgctcccgctcggcgggaagtgctgcgtgccctgtccatgggcgcgcagggcgcggcggtccaggtcctccatgcggcgccgtagctccgcgcagcgggccgtcgcacggtcgtggtcgtcgcgggcccaggcgaggtccaggcggacggagtcggcctcctcgtgggagccggccgacggaagcagccggcccagctccgcctggcgctcggcggcgtagcgctgttcgcggagcatcacgtccagccggtcgccgagggcgtcgcggccgccgggccgggcgtcgtacgcggcgagcgaggcggcgtgcagcgagcgggcccgctcggcctcctcggccacggccccgggaccgtattccgcggcgaggtcctggaggagcgcctccaccacgtcccagggcggcacctcccagccgtcgagacaggcccgcatgccgtcggggtcccgctgccagaacactccgcaccagccgccgtcctgatcgagcctggccagcaggccgttcaggtacctcgcgaactcccccacctgtctcgggagttgttccacagccatcgccacaactcccgccagactggagtactccgatccggtagaaaacaccaaccgtgttacggaacggctacgaggagttttcagaccggacgcagagcgctccgccgaagcgcggggcgtccgtgcgcgcccccgctcatacgccgatcagtacgcaccgcccggcgatgtcgtccatggacagtccgagtgcgcgcgccagcgccgcgacggtgaagaaggccggggtcggggcgcggccggtctcgatcttgcgcagggtctccgccgagaggccggcactcgcggcgacgtcggccatggtgcgactaccacgggcctcgcgcagcaactgcccgagccgctcgccgcgttcatgttcttcgggggtcagcggggtgcgcaccatgaccacattctaataccggctcgcctccgccggagagccgatcgggcgttatgccaatagggccctaccggtataataattggcatggtggaactcaagacggatacgtcgatcgacgcgatgcacgaggcgggccaggtcgtggggagagctctcacggcggtgcgggaggccgccgacgtgggcgtctccctgctggagctggacgaggtggcacgcggagtactgcgggaggcgggggcctcgtcgcccttcctcggctaccggccgtcgttcgcgcccacgcccttcccggcggtcatctgcgcctccgtcaacgaggcgatcgtgcacggcatcccggacgggtaccggctgcgcgacggcgacctggtctccgtcgacttcggggccgaactgggcggctgggtcggcgactcggcgatcagcttcatcgtgggcacgccccgggccgcggacgtacggctcgtggagaccgccgaacgcgcgctggccgcgggcatcgcggcggccgtcgtcggcaaccgcatcggggacatcgcgcacgcgatcggctcggtgtgccgggcggcggggtacggcatcccggacggcttcggcggtcacggcgtgggccgccggatgcacgaggacccgccggtgccgaacgagggccgccccggccgcggtctgccgctgcgccacggcatggtgctggcgatcgagccgatgctgatcggcggcggcacggacggtttccacgcggcggcggacggctggaccctccgtaccgacgacggttcacgcgcggcccacgcggagcacacggtggcgatcaccgacgcgggaccccggatcctgacagcccgcacaaagacccacgccgcctgaagacccacaccgcccgagaacgcacgcgcggcggccggcggcaggcgtctcagcgacggcacgtccgcgcggacgcggaccggttcagagccccgcacacggccgccggccgggcggtccgcgccccaccggtgtccggccaccgcctgtcgcgccacggctgcgccggggcggcggccgaacacctgggcccgtctacgacgccggccgcaccaccatcgccgacccgccgccccggcgcaccttctccgccgcggccagccacttgccgttcgacaggcgctgcacgcccgtcgccgcgccgatctccgggttcagcttgaaggagtgcccgatggcttccagcttgcccctgagcgtgctgtcgtacaggcccggttcgagctccgtctgggccgcgttgcgctggctggcgcgcggcgcggcgatcgcgtcgaccagcggcagcccgcggtcgaggaacccggtcagggtctgcagcacggtcgtgatgatggtcgcgccgcccggcgaaccgagcgcgacgaccggcttgtcgtgccggtcgagcacgatcgtcggcgagatcgacgagcgcgggcgcttgccggggccgggcaggttcgggtcgtgcacggccgggttcgccggggtgaaggagaagtccgtcagttcgttgttcaggatgaagccgcggccggggaccgtgatgccgctgccgccggtctgctcgatggtgagcgtgtaggcgacgacgttgccccacttgtcggccaccgtgaggtgcgtggtgttctcgccctcgtacgtcgtcggagccgccgtgcccccggtggcgcaggccttcgccggactgcgcggatcacccggcgccagcgggctggtcagcaccgcgtcgtcgctgatgaggcacgcgcgcgagtcggcgtacttctgcgacagcagttccttcgtgggtacgtcctcgaaggcggggtcgcccacccagcgcccccggtccgcgaacgcgatccggctggcctcgatgtagtggtgcaggtactgcacctcgtcggccttcgacaggtcggtcttctccaggatgttgagcgcctcgccgaccgtcgtgccgcccgaggaggagggggccatggagtagacgtcgaggccccggtacgaggtcttcgtgggcgcctggagcttcgcgcggtaggcctcgaggtctttggccgagagtcggccgggccgggcgttccagcccgaacttggctccacgggcggcttgttcacggtggcgacgatgtcctcgccgagatcgccgcggtagaccgcgtcgacgcccttggtgcccagctcggcgtaggtgcgggcgagatcggggttcttgaaggtggaaccgaccaccggcagctcaccgttcggcaggaacagcttcgccgtgtccgggaagtagcggaaccgggcctcgttggaggcggtctgggtgcggaaggtgctgtcgaccgtgaagccgtcgcgcgcgatccgctccgccggcttcagcaccgtgccgagccgcttgctgccccacttgtcgagggcggtctgccaggtggcgggcgagccgggcgtgcccacgctcaggccgctggtgacggcgtcggcgaaggcgagcgccttgccgttctcctcgaacaggtgggagtcggcggacagcggcgcggtctcccggccgtcgatggtgcgcaccgtacgggacttggcgtcgtagtagacgaagtagccgcccccgccgatgcccgacgagtacggctcggtgacgccgagcgccgcggcggtggcgacggccgcgtccaccgcgttgccgcccttcttcagcacctcgatgccggcggcggaggcatccgcgtcgacgctcgacacggcaccgccgtagccgacggcgaccggaactttccgcaccgaggtgaccgcggtgggtggagccgccgctcccaccgacaccaccgcggccgaaaccgccaacaccgccagattccgtgccacaggccgacgcatccgtacctccagatcacaggcgtctgcgcagcgtaaccgtatcgccatggccccgtcaggggctcctccaacagcgtagaacgcacccggctagcatgcgcgcccatgaatgacgacgtgcgcaacatcgtcctcggcgtggtcgcggccggcatcagcgccgccctcggctggatcgcccgtacctatctgtggaagcggaagctgcgccgcaagcaggcgttcttcgggctgcccgacaactcggagtcgctgctggtggtcaaccgcgaggcgggcggccccgagctgacggtgatgcgccacgacgtgttcgcgctgctcgaactctccgcgctgatcaaggactgcggcgcgcacgcccaggtcgtcgcgcacgacgcggcccagcagggcttcggcgagcgcaccgagttctgcgtcggcgggccgtcctcgaaccgccggatggccgcgcacctccacagcctgctgccgggcatacaggtgaacaccgaccccgaaccgggcccggaccgcggcgcgttccagatcggcaccgagcgctaccggctggagtccggcaagggcgagtacgtgctcctcgcccgcctcaccgccgacctgggccacggcacacgaccggtcttcctcttctgcggccagcgcgccatcaccaaccaggcggccacccgctatctcgcccgcaaccacgagcgcctcgcgcgcaagtacggcggcaactccttcgtcctgctcctgaaggtcgtcaactcccaggcgtacgggcccgatgtcgtcgaactcgtcgcggacgtcacccgggccgcgcagaccccggcgccggtcgtggctccccgcaactcgcaccgcgcctcctaggtttcaggccattccaacaatcgttactggcacgtaacttaccgacgggttacttaaggtaaggagctgcggttaccgtcgggtcactttgcactgacaaaagtgaggagtgacccgtgggacacgcacgcaagaccctgcgcacgaccgcagtgagcgccgtatcggcgaccctgatcgccggcaccgccctcgggctcgcccccaccgcacaggcggcgtcgggcggcgtcagcttcgtcgacatcgccggtgacggcggcacggtcctgaaggccaatgtcgtcacgcccgccggcgccgacggctcccgcacctacccgctcatcgtgctgccgaccagctggggcctgccgcaggccgagtacctcgcccaggcccacaagctcgcggactccggctatgtggtcgtcagctacaacgtccgcggcttctggcagtccggcggatacatagaggtggccggcccgcccgacgtggcggacgcctccaaagtgatcgactgggccctcgcccacaccccggcggacgcgcggaaggtcggcatggcgggcatgtcgtacggcgccggcatcagcctgctcgccgcctcgcacgacaagcggatcaaggcggtcgcggccctcagcggctgggccgacctcaccgactcgatctactcgggccgcacccagcacgtccaggcggccgccctgctggacggtgccggaaccctcaccggccgcccgagccccgaactccagcaggtcttcaaggacttcttcgcctccgacctgtccacggagccggacctcctcgcctgggggaagaaacgttcccccgagacgtacatcgaccagatgaacaagaacggcgcggccgtcttcatggccaacggctggggcgacacgatcttctcgcccaatcaactcgccaagtactacgaggagttgaccggcccgaagcgcctggagttccgccccggcgaccacgccaccgccgagatagccggcctgttcggggtccccaacgacgtgtggacggacacggaacgctggttcgaccactacctcaagggcgaggacaacggcatcgacggcgagcagccggtccagctcaagccccgttccacgggtgactacgagggctatccggactggaagtcggtcggcgcgacgacgaagaagatcgccctcacgggcaccaccacgatccacacgaacgtggactcgggcgccaacggcgggctcatcttcctgtccagcatcctcgaccagctcgcccagctgcccccgatggcctcgatcccgctgctgccgcgctactgggccgccgtctggcagtcggagaagtacacgagcggccaacacgtgcgcggcacggtgaagctgcacaccacggtcaccggcaccaaggagagcggcaccctcgtcgcgtacctctacgacgtgggcccgctcggtgtcggcaagctggtcagcaacgctccgtacaccttccacggccagacccccggtcagccgttcggcgtcgacctggaactgtcctccacggcctacgacgtcccggcggggcaccgcctcgccctggtcgtcgacacggtcgactccctctacatcgagcacaacccgtccggcgcgcagctgaccttctcctcgccggagcacgacacctcatacgtgtcggtacccctgcgcgagcagtgatctccggctgctgccggccgggcctggccctgtgcgctgctgctccccctatggtctcggggccgtggggggacccccacgcggcagcagcgtccctggctcggccgcggcgacttccacggcctcggtcttgggactgcgctgctcacgccgggacacccactgggcgaaccaggaaagcagcatgcacatcccgatgtagatcggcgagatcaccatcaccacggggatgaacggcaaatcgtagtcgaggttcgacgcgatcagtttcccggcgtggaggaactcctcgtaggtgatcagataaccgagcgaggtatccttcagggccaccaccagctggctgatgatggcgggcagcatggcgcgtacggcctgcggtacgagcacgtgcgccatcacctgcgtcttgcgcatgccgagggcgaacgcggcctcccgctgaccgcgttcgacggactccacgcccgagcggaagacctcggcgagcaccgagccgttgtagagggtgagtcccgcgaccagtgcgggcagcggctgcaccttgagcgccacgaagatgaagaagatcatcaccagcaccggcatggcccggaagaactcgacgaccagcgtggccacccagcgcaccggggcgtggtccgagagccgcccggtggcgagcaggccgccgagggccagcgagagtaccgcggcgatcccgaaggccttgagcgtgttgccgagaccgcgcagcagcagttcctggattcccttgtactcgaagggcatccacttggtgtacgtgaactggccggtgtcgaagaggagatacacgatccagccgaccagggcgagcagaacgacggtcgacaacaccccgtacagtcggtgccgttgtcgcgtcctgggcccggggatgtcgtagagggccgtggcctcaagggttttggtggtcatcgggcgactccccagcggcgttccagaaagttgaagatcgcgctgatggtgagggtgatgatcaggtagccgacggcgatccagacgaaggtccagacgatgttgtagccgagctcgctgagcgtcttgtacgtgccgagcagctcgttgacgctgaacgcgccggcgatcgcggagttcttggcgagggcgatgagcgtcgagccgaccggcgagatcacggagcggaacgcctggggcaggacgaccacggacagcgtctgctcgaacgtcatgcccaggctgcgggccgcctcgccctgtcccctgggcacggtgttgatgccggagcgcagcgcctcacagatgaacgccgaggtgtagcagccgagcgcgaggaccgcgaacacctcgaagggcagaacgagtccgaaccgcggcaggccgagcagcaccgcgaagaacagcagggtgagcggcgtgttgcgcagcaccgtcacccaggctgtgccgaaggcccgcagggaggcgacgggagcgacccggaaggaggccatgaggaacccgaggacgagtgccagcgccgaggcgtagacggtgagttcgaccgtcccgaggaatcccttggcgaaggtggagaagttgtctgtcagtacgttcacatcggcctcgctcagctcgccgggtagcggtcgatcgcgggcggggtgggcgccggcacgccggacaggccgagcgtcgcctcgtacgccttcttccagtcgccgtccttctcacgggcctccagcgcgtcgtcgagagcgaacctgagggcgttgtcgttgcgcgggacgccgatgccgtagggctcctcggagaagggcttgccgacgaccttgagctcctcgggcaccttcgccgcgtagccgatgaggatcgcgtcgtcggtggtgacggcgtcgacctggtaggtgagcaggttgtcgacgcagacggagtacgtgtcgtacgcgacgagcttcaccttcgggtagtcctgctggatgcgctggtacggggtggaaccggcggccgagcagacgcgtttgccggccaggtcctgcggcccgttgatcccctgctcgtccttgcggaccagcagggactgacccgccaggtagtacggaccggcgaagccgacgagcttcttgcgcttgtcgttgatggtgtaggtgccgacgtagtagtcgatctggccgttctggagggcggtttcacggttggcggaggcgatggtcttgaagcggatcgtgccggggtcgaagccgagcgaggccgacatcatcttggcgatctcgatgtcgaagccggagaaggcgccgctcgccgggtccctctcgccgaggtagggctggtcctccttgacgccgacggtgaggtagccgcgcttcttggcccgcttccaggtgggcgagtcgttgagctgaaagccctgcgccacctggtagtcgggcagtttgtcggtggccggtcccttggtgggcggactgccctccttgccgcaggcggtcgcgagaagtgccgtgatcaggacgagggcaagggcaagacacacacgtgtgctgcggatcatgggtcgcactcccccggctcagtgcttgaggatcttggagaggaagtccttggcccgctcggtgcgcgggttggtgaagaactcctccggcgtgcggtcctcgatgatgcggccgtcggccatgaagacgacgcggttggccgccgagcgcgcgaagcccatctcgtgggtgacgacgaccatggtcatgccgtcgcgggcgagctgctgcatgacctccagcacctcgttgatcatctcggggtcgagggccgaggtcggttcgtcgaacaggagcgccttggggttcatggcgagggcgcgggcgatggccacgcgctgctgctggccgccggagagctgcgccggatacttgagcgcctgatcggcgaggcccacacggtcgaggagctcccgggagtgcctgtcggcctcgtccttcttgcggccgcggaccttcacctgcgccagcgagacgttctgcagcacggtcttgtgggcgaagaggttgaacgactggaagaccatgccgacctcggcgcggagtttcgcgagcgccttgccctcgtcggggaccggctgtccgtcgagtctgatcgtgccggactcgatggtctcgagccggttgaccgttctgcagagcgtcgacttgcccgacccggacgggccgatgaccacgaccacctcccccttgccgacagtgaggttgatgtcctggaggacatggagctcgccgaagtacttgttcacgtcatgcagttcgatcagcggatcgacagccatgcagcccgccctactcactctcagctgtgtcgcagtcgccgcaaactatccagccaggaacgggcttaatactcgacacgcacttttcgggcattagccgtatttacgcctcggcttacggttcggcgacctccgcgtacacctgggagagctccggtgcgccggtcgtcgcccactcgtgaccggcggagaccacgtcgacctcacggccgccggccagccgcaccgtgggccggccactggtccagatctcccagtcggcgcccgcgaccgtgcgcacgatgacggtgccgagatagagccccgcgtcgtttcccagccagggcaggatctcctcgtcgtcgcgccagcgcggcaggagctggtcgagcgcctccagcgaggtcgcggagtcgtcgagttcgacgcccgcctgctcggcctgcgagcgcagcagctcgcactccgagagaagttcggcgaccccttcgcgatcactgtcaccgtcggtgaacaccgcgacaccgaaggccgcaccgtgcttcttgcgccagttgcccaggaaagggatgttcatacgcctagcgtgtcattcgcacgacctgccgcaccacaggcgcgcggacctggcctcgcacggagccgcgcacggacccggacccgtacggatccggcccgatcgccgcgggtgcggccaccgcctgcattgacgtgtacccgacgcctccttagcttcagggaagatctgacatcacctcggcttccgtggggagaggagcgggacgtgcgtcgacgtctttggggggcggccgcgctgctcgggctgttcgcgggtgtggcgccggtcgcggcggcggaggcggtcgcggcaccgcacggcgccggaccggtcccactggaacggctcttcgacaacaccgcggtcagcgacgaccagcggccgggcgccgcggacttcgacggctcggggagctccctgtccgcgcaggacctgacggcggccggctggacacccgggcgcacgctgacagtgcagggcgcacggctgacctggccgcgccgggcggcgggcgagcccgacaacgtacgggccgacgcccagtcggtccggctgcgcggccgcggcgacgcgctcgccttcctcgccgccggcacggccggctccgacgtgagcggcacgggcacggtccggtacgcgaacggcacccgctcctcgtaccggctcaccgcctcggactggcgcaccggcccgctcgccaccaaggcggtggcgctgccgcacatcaacacccccgcgggtcaactcgccgagaaggcacggctgtacgtcgtgaccgtgccgctcgcgcacggccgcgaggtcgcctcggtgacactgccgcggggcggcgacctccatgtgttcgccctctcgatacgtccttccacccgtggctggacgggcagttgggcggcctcgacctccggttacacggccgtcggcccgtggacggaccggactctgcggcttgtggtgcacacctcggcgggcgggccacgggtgcgcatccggctcgacaacacgttcgcggcggcgccggtgcggatcggcagcgcgacggtggcggtgcaggaggcgggtgcccggcccgtggcggcaccggtgccgctctccttccggggcgcggccggggccgagatccccgcgggggcgcaggaggtcagcgatcccgtcggcttccaggtgccggccgacgcccaattgctggtcagcttccatctgccggggacggtgaccgcagcgcccgtgcaccggctcgcggtgcagcggtcgtacgtcagcgagccgggcgaccatgcgggcgacggcactccggacgcgtacacctcggccatcacctcgtggccgctgctgaccggcgtggatgtgggcggtgggccgggctccgtggtgatgctcggggactcgatcaccgatggcgagaagtcgacgcaggacgccaatcaccgctggcccaatgtgctcgccacccgtgtgctcaaccaacatgtggtcccgcactatggcgtgctgaaccagggcatctcggcgaatcgtgtggtcaccgaccgctatcccggagacgggatctccaccgacaccggcggggtgagcgcgctgcaccggctcgaccgtgacgtcctggcccagacgtccgcgcgcacggccgtcgtcttccagggcgtcaacgacgtccgctggggcgcctcggcggatcaggtgatcgcggggctccgggagctggccgaccgagcccatgggcgagggctacgcgtcctggccgcgacgatcgcgccctgcgagggcgagtccctgtgcaccccggccgccgacacccggcgcaccgcggtgaacacctggatccgcgcgagcgagagcttcgacggcgtcctcgacttcgacgccgtcgtacgcgaccccgggcatcccgcacgcctcctgcccgcatacgacagcggggaccatctgcatcccaacgacgcgggcctcgcggcgctggcggagtcggtggacctgacgctgctgtgagccctgctacgcgtcctgcacgtccaggtccaccacgaccggcgcgtggtccgacgcgcccttgcccttgcgctcctcgcggtccacgtacgcgtccttcaccgccttggcgaacggctcgttgccgtacaccaggtcgatgcgcatgccgcggttcttggggaagcagagctggcggtagtcccagtacgtgtaggggtgctcgtacttcagcggacgcgggacgacatcggacaggcccgcctcacggagcgtcgccagggcggcgcgctcggccggggtgacgtgggtgaggccctcgaaggcggccacgtcgtacacgtcgtcgtccgtcggcgccacattgaagtcgcccatcaccgcgaacggccggctgcccgccgcgtcgcccgcgaccgccgccttgagggcctcgaaccactggagcttgtacgcgtagtgggggtgctccacctcgcggccgttcggcacgtacaccgaccagacgcggaccgggccgcaggtcgcggagagcgcgcggggctcctggacgccgtcgaagccggggtcgccgggcaggcccctgaccacgtcctcgaggccgacgcgggagatcaccgccacgccgttccaccgccctgtggcgtgcaccgccgactcgtagcccagctcgcgcagcgcgtccgccgggaactgctcggcggtcgtcttggtctcctggatgcacagcacgtccgtgccgctgctctccagccaggccaggagcctcgggagacgggcggtgatcgagttcacgttccaggtggcgatgcgcatgcctcacaacctaccgggctggtatgacaaccggtcgcgcggtggtcccggcgccggacctcgcccgactggtcccggcgtcagacctcggccgacgcgcccggcgtcagacgcaggtgttcggagccgccgagggcgccgatctggtggtcgtagatcgggcgggcgaggtccgtgaggagggcgtcgtggatgtcgtacgcgcgctggggcttgacctcgcgcacatagtcgatgacctcggcgatcttgctccagggggccatgacggggagcatcagcgtctcgaccgggtggtcggggacggtgagcgcgtcgcccgggtggaagacgcggccgtcgtcgatcaggtagccgacgttggtgatgcgcgggatgtccgggtggatcacggcgtgcagttcgccgtgcacctggacgtcgaagcccgcggcggtgaaggtgtcaccgtgcccgaccgtgtgcacgcggcccgggaaagccgcggagagcttctcggcaaccgacttcagggtccagatcccggccgccgggttggactccaggcccgcccgcagccggtcctcgttgaagtggtcgaggtgctcgtgcgtgaccaggatcgcgtccgcgccgacggccgcgtcctcctcgctgaaggtgcccgggtcgatgacgagcgtgcgcccgtccttctcgaggcggatgcaggcgtgcgacttcttcgtgagcttcatgagtccatcctgcccccgccgacgcgacggagggctgccgagactggtgctctcactgccaggctcaaaggatcactcctggggcgtggtctcctcccggatgacctgctgggccaccttgaaggcgctgttcgcggccggtacgccgcagtagaccgccgcctggaggagcacctccttgatctccaccggcgtgagcccgttgcgcagggccgcgcgggtgtggaaggcgagctcgtcgaggtggccgcccgcgaccagcgcggtgagcgtgacgcagctgcgcgcgcgccggtccagcccgggccggtcccagatctcgccccacgcgtaccgggtgatgaactcctggaaatccccggagaacgcgtccgccgaggccagggcccggtcgacatgcgcgtcgccgagcacctcgcggcgcaccttgagcccggtctcgtagcggtcgggcctgcccgcgggctccggctgcatggcggccggcgcgatctcggcgaccggcgcgaccggtgccggcgcggcgagcaccggcttcacgggggccgcgggaatcgccgtctggccggtggtcgactcgaaggcgggctgccaggcggtggagaagtgccgcacgagcagatcggtgaccgccgcgggctgctccaccggcaccagatgggaggcgccgggcacgaccgcgagccgggcgtccggtatcccggcgaccagggtgcgcgcctcggcggggccggtgacctggtcgtccgagccgacgaggaccagcgtcgggacgccgatccggctgagttcggcgcgtacgtcgaaggcggcgagtgcctcgcaggacgcgatgtaacaaccggggtcggtcgtccgcaccatctgcacggcccactctgtgatcgcgggctgggcggcggcgaacccgccggtgaaccatctctccggggacgtacgggcgatggggtcgagcccgttcgtccgtacgatcacgccgcgctgccggaactcgtcggccgtgccgaagcgcggcgaggcggcgatcagcgcgagcgaggcgaggcgttcggggtggcgcagtgccagctcggcgccgacggcaccactgagcgcgcagcccgcgtagccgaaccggtgcacgccgagggcgtcgagcgtggccagcagccgggcggccaggtcggtgacggaccccgcggggtgcgcgggcgcgccgccgtgtcccggcaggtcgaaccggaacacccgccactgcttcatcagctccgggacctgccggtcccacatgtgccatgtggtacccagtgagggaccgaggatcaggaccggggcgtcttctggcccgtcaaagcggtattgcagggtgttcatcggtgtctcactcacccgcctgaccctctcatctgtcacgacagcccctatgagcggggtgctggccgtagctgtttgaccaggtggaagacctcccgggccgcgtagcgtttgaggcaacgcacgatttcgcgccgggtcctgccctcctcgatccgccgctcgtagtggtcctgagcgcgcgggtcgacccgcaggcgggtgaacacgatgcggtggagcgcggcgttggcctgccggtcgccgccgcggttgaggcgacggaactgccggcgtcccgaggagcgctcgacggggctgaccccgcacaaagcggcgaaggacgcctcactgtccagccgttccgggttgtcccccaccgtgatcagcagagcgaccgccgtgtccggaccgatcccgaccacgtcgagaagctgcggggcacgccgttccaccagccgggtcagacgagcgtcgacgttccggatctcctcggagagctggccgatccggtgaaccggcaggcccagcgtgatccgggtggcctgcaccaccgactcctcgccgacctcctcgcgaccacgcgcatcggtgaactgcgcgcaggtacggacgagtaccgccactccgccctgacccacctcggcgagcagggcgcctcgctgctgacgctgatggcgaagtccggcacaagaagccggagaacgtccgcccctacttcaagccttctccggaggtgatcgccgagctcaccagcctgctcgcccccacagacgcccgccgctgaaacgtcgccgcccgacagagcggagccgttcgggtggcggggttcgtgtccaggacacgcgtggctgctcgttggcgcccgggggcggtgatccatgcggcccctgtgatggggggaagggggtcagccttcacggctggggagcatggccagggcctgggagcgctgtgcgacgaggtcgtcgtaggtgccgtcgcgctcggcccagcggtgcatgagtgccgccttcacgaggatttcgcggggggtggggtcctctgagagcagttgcacgacctcggtggcgaagtcgtcgagcggcagcgcgtgcgggttcaccttttcctggcctgctgtggcgacggccggggggacgagttcgacgacgctgacgccggtgccgtcgagttgcgcgcgcagcgcctcggagtaggcgtgcaccgcggctttcgaggcggcgtaggtgggcatgggcgggaagggcaggaaggcgatgccggaggtgacggtgatgaaggtgccggcgccccgccggaccaggtgcggggtgaaggcgtcgatgacccggatggtgcccaccaggttggtgtcgatcgtcgtcgctgccgcctcgaagtgcgcggggtcgcgcaggtcctccaggagcatgatgcccggcatcgtcaccacggtgtccagctcggggtaccgggcgagcacggcgtcacgggcagatgcgacggaggcactgtcggtgacatcgatgctgattgtgccgaagccttctccggcgagttccgagagtgcctccgggctgcggccgccgacggccacggtgctgcccgctgcggcgaaccggcgggccagctctcgtccgatacccgaggtcccgccgacgatgagaacggtgcggttggagagatccacgagatcttcccttcagttcagagcgccgacggcgttcagacccgcggcgccattcggcgatgttctctgtcctttgtgaacagtgatgccgcaagtcttggcggtatccgctgagcgtggcagggcccccgtcttccctggtcctgccagggcccccgctgagacgcacgcaccgcactacggtgtcggtatgaaggatgaggaatccggcaaccggctcggcagctacctgcgcgcccggcgtgagctggtctcaccggcgcgggcggggctcccgcccggcggcaaccgccgcgtgcccggcctgcgccgtgaggaagtcgccctgctcgccggcatcagccccgactactacctgcgactggaacggggacgcgacaagaatccctcacctcaggtcctcgaatcactcgcgcgtgtcctgcggctcgacgacatcgagcggacgtatctgctcggcctcacggcagcacgccccagggctccgcgccgcaagcgacccgagcacgtaccggcacgggtgcaccagctcctcgcccaccttcggattcccgcgttcgtcgaaggtcgcgccttcgacgtcctggcctccaaccccatggccgtcgcgctctccccgcgcctgcggcccggccagaaccggcttcgttccctcttcctcgatcccgaggaacaagcctttcaccaggactgggccaaagccgccgccagcttcatcgccggccttcgcaccaccatcggggacgacaccgacaacccccggtttgtcgaactcgtcggagagctcgcactgtccagccagcggttccgcaccctgtgggcccgacacgacgtccgcaacctcgacggaggcaccaccaccgtccaccaccccgtcgtcggtgaactacggctccaccgcgacaaactccccatcgacgacgtcatcctcgttgtctactaccccgacaaggccagcgacggcgacgagaagctgcaacttctcgccgcactctcacagaccgaacccaccgacacagcacacagcaggcaggcagacgccccgcgcccgaaaacaccctgacgaacaccggcctcccggcagtacagccagaacggccgcgccacgatgtccgccatccgcggaccgtctcggcgcccggtcattggtcgtcggtggcgtccggggcgcgcaggggccgcaggccgccgggcaggtcggggagctggaaggagtagcggcccagcatgttgatgtgatggcggacgaacgaggagaggcgggccacgtcctcgtcgcgggcctcgaacccgtcctcgcgcggctgcgtgacggcggcctccaagtacctcgtgttgaacagcgcattcaggaccaagcccagcgcgccgatctggtcctccatgccgtcctggtaacgctggtagagctgtccggcgttgccgtggaagatcttccgggcgagcgcgcggcggcccctcctggaggttggcctgcgccttgaccacggtgttctgcgggacagtgcgagcccttcgggcgaccagccttgccccgctcccgcctgctggagcggggcaacaggtgggcgttctcctgctgaagggagaactggctctgtcgacgaggaccgccacgcgcgccgcggctcaggccgaggggaaaccggctgtcaggcaggccaacagccggcccggcgcgtcttcctggagaaggtggccggcgccctcgatccagtgcagctccgcgtgcggaacgcgttcgtgcaaccactcggcgtaccgcggcggaagaatgcggtcctcgcggccccagacgagccgcaccggaagcgacataccgcccagcaagtgctcgtacgcgaccgtgtccgcctgcctgatctggctgtactgacggtagaacgccgcttgccctgagtcccctcgccacggtgcgaggaacgcatcgagaactcccggccggaagccgacgtgcgtggcgtgccgcaggtggctggcgaccagcgcttcgtgcgcgtaaccgggaagcttctggaagacctcctcgtgctccaggaagagctggaagagccctctctcccactcgccgccgctcaccgcgtcgaagagggtcagatcctggtagctcctcttctccagcagcaatgtccgaagcgccactgccccgcctatgtcgtgggcgaccacgctcgggtcggatagctcccagtggtcgaggagccgggcaaagttcctcgcgtgagccgccaggctgaggtcctggccctcgcgtcggtccgactggccgaagccgagatggtcgaaaaagaagaccttgcgggtgcgggcgagggccggagcgatgtcccgccaaagaaaggaagaatacggcgtgccgtgcaccagtacgatcgggtctccgcgacccaaggtcccccaccgcaccaccccttcaggcgtcgcaaattcctcaccaagcgtccagtccatcactggcctcctccttgcctcatgaacagcgccttccacggagagcgtgcctcgatgcctcatcagcaagaagctcccgcatctgtggtcccaggctcaccggcatcacccttgccccgaagagggcgagccttctgcgagcaagggtgaaagttccgaggaacgtgcgggagccgagggccactgtcgcgatggctgtcatgaccatccggccaaccggcgcggggccaaagtcaccggcaaacgcgcctcggcttctacctcggcgccagcgcacaaagcttcaacgacacacccgcggtccacgacgcagacctgcacaccgcccgccacctcggccggcgcgtcgccgagcacactcggcttttgggctcacctcggcgctaccccccttacggtcgggtgagaatttcggctccgctgtcggtgatggcgatggtgtgctcgctgtgcgcggtccggcagcctgtcgcgctgcgcagcgtccaaccgtcggcgtcggtgacgagtgtggcagtgtcggccatgacccagggctccagggcgagcagcagtccggggcgcagcttgtatccgcggccgggccgtccggtgttcgcgacgtgtgggtcctggtgcatggtcgagccgatgccgtggcctccgaactcggtgttgatcgggtagcccgccttgctgaggaccgtgccgatggcgtgggagaggtcgccgatgcgcgccccaggcttggcggcggcgatgccggcggcgagtgcacgttcggtcgcctcgatcatcgcgacgctctccgccggcctggccttgcccaccagaaagctgatcgcggcgtccgcggccaccccgcccctggctacggcgaggtcgagagtcagcagatccccgtctgccagcgtgtagttgtgaggccgcccatggagcactccgtcgttgacggccgtgcagatgtagtgcccgaacgggccgcgcccgaaggaaggcgcgtagtcgacgtagcaggactgcgctcccgcctcggtgatcatctccttggcccactggtcgatgtccagcaggttcgtcccgaccgcgctgcgctgcttcagcgtgtgcaggatgtttccgaccagggcgccggtgtccctcgcccgctcgagccgcgcggagttcaggatctcaatcatgggggacctctcatgtacggccaataactatcccggtctaactataccggtattagaatggggtcatggtcaggttgccgctcacccccgccgaggtagaacgcggacagcgccttggcgccctgctccgccgagcccggggctgccgctcgatgctggacgtggcgctcgcttcgcacatctcgccggaaactctgcggaagatcgaatccggccgtgtggccacccccgccttcccgaccatcgcagcgatcgccgacaccctcggcctgtctctcgacgccgtctgggccgagatcagccaggcggaacgaaccgtcgaggaccagtcggtcctgcctgtcacacggcatccatcgctggtttcgtaacgccgcactcggcgagtcagcggttcactgaccgcgctgtgccggtacgcctgcgcgcacgctgatcacctcgtcgaccagcccgagcaccgcccagcggacctcggcggctacaccgacctggccgcctgtcggctccgtcgcttcctgcccgaagggcgcgagcgcccgcaccctcgccgcgtgcccgcacatggggaaggcgtgggagacccggtagccgacgcactcgcggcaggcggcgacaccgccgttctccacttcggcatcgcggtgcggttggagatccgctcctcccactcgcgcccggccgcacaccgccaccacaaccgacgggcttcgtcgtgctgtcaggtgtcacgcgcgaatcacagaccccgcggacaccctcctgacacaggatcccgaaactggacattcctctcgctcggggcgctggcccccaagtctgcgcacccggctcccggacatcaccgggagatcctcacaccgccttcaccagatgtcggccggcggtgtcgcggaggcagcccgggggcccggcgggttgaacgtcggctcacgcttcgtccggtgcgccgagacccgtcagggcgccgaccgggtccaggtccggggtgccccggggccaccagtcgtcgtggtccggttccgattcgtaggcgtaccagaggccgtcgtggccgaggcggagctgggcatggcccttcggatgggtgaggcggttgcgccagggccggaacgccgggaggtcggcagcgaggagaagcgggcgggcgcggtcgaaacgtccggccggcggatcccagggttcctcgaggacggcgagcccttcgagtccgccctgtcgccaggcggcgaccgcccgggccaagtccccggtggtccgtccggcggcggtggccagcgacgcgtacagcgcgcgtgtcgccgcggtcagaccggaaccgggccgggcggcggcgagtcgtaccgcgtcctgccacagcgtcagctcggccaccggatcgcgtccggcggtgagcagggcgtgcgcgcgggcggccgcgtcggtggccaactggtccagcgcgaacgggtccggcccgcccggggccgccgggtagaccgggggctgctccgggtgcgggggcgccggcagcggtgccgggaggggcgggagcgaacgtcgggcgagggtgtcccgggcgcgtacgccgggcagcggtgcgggttcctgttcctgggcggcgcgggccgcgcgggcggcgttgcggcgggacagggcgtccagcacctcgcgttcgccgcggccgcggagcaggagcaggacgaacgggtcctcgtccagcagtcgcgcggtctggtagcagagggccgccgcgtgcttgcaggggtggccggagtcggggcagctgcactgcgggtccaggtcgcggggctcggggagcagcgggatcccgcagtcggcgagggagtgcggcatctccttgtcgagcagcgcggcgatgtgcccgggccgttcggcggcggcgtccaggaaacggtcccagtcgtcgtcggagagcgtgcgcagccggacctgcacgcggtacgggcgcggacggctgccgtgtacgtacgcgagcacgagcccgggcgtgacggtgatggcgtccacgtgcccctgtccggcgtacaccctcccccgcgccaggcgggccgcgtccagggcgccttcctccagcgccgacacccaggcgtcgccccaccaggtctcggcgaaccggtcgacgccgacgccgtccccggtccgcgccggaagggcggcgaaggtgcgccgcagttccccgtcccggccgggggcggccatggaacgggggacgcgcggggccgagggctgatgcggcgtgtcttccgagggcgccgaacccgtcagcgggcgggagggggagacggggggacggggctcggtctcgcgcccgtcggcacgacggtctgccgtcggcgtcgacctgccgctccacacctcgtcctcggcgtgcgtcgaggacgaggtcgaggcgtgcgtcgaggccgcgtcccgcgtttcgtctcgcggggccgcgtccgtgggaagcgcgtccgcaggaagatccgtcgggtcatccgcaggaagtacgaaggcgccggcgaggaactcccggagctcccgggcccggttgcgcctctcgtcgccctcgcccggtgtgccctgtcgctcccgggaatcggtgcggctcgcaccggccgaacggcgtgcggccccgactcccctggccctggcctctcgctgcccctgcttcgcgtcatcacgcgcggcacgcaacgcctgccgtgcgatgtcgccggggcggccggcctgagcgtcttccttcgcggcgggcagcccggaccagccctccgcaagctcctcgccttcactggactcaccggactcactgtgctcagcgggccggctgggctcagcggggctgtccggtgccggtggtgctccctcgccggacccggcagcgctcccccgcgccgtcgcccgccgcaatgcctcacgtgccacgtcgccgggccgggagcgtcgacccgaggtctcgtcggacgtcgtggggcccgcgtcccgcaccgggtccgcctcggcctgggcatcggcatcggcatcggcatcggcctgggcatcggcgcggggagcatcggcatgggctcgggcatcggcatcggcatcggcatcggccgcgtcagccccccgcgcgtcccgcccccgcgcggcgcgcaaggcgcgccgcgccacatccgcgggccgctgcgagccggaaacatcaacctcaccggccgggtcgtgcgggccggtcacgtcggccccgtcggcggagcgccgaggatcggccccgtcggcggcccgctgccagggggaccgctccgccccgtcgtccatcccctgggtccccgtcatgtcggtcatgtcggcctccgcagcgacaccaggtccgacaggtcgcggtcggtcagttccgtcagggacgactcgcccgagcccaggatcgcgtcggccagggcccgcttggcctccagcatctcggcgatgcggtcctcgaccgtgccctcggtgatcaggcggtggacctgcacgggctgggtctggccgatgcggtaggcgcggtcggtggcctgttcctcgacggccgggttccaccagcggtcgaagtggacgacatggccggctcgcgtgaggttcaggcccgtgcccgccgccttgagggagaggaccaggaccggggtcgtaccgctctggaagcggtccaccatccgctcccgctcggggaccggggtacccccgtgcagcagctcgacggggacggcgcgcgaggccaggtgtgcggtgatgagacgagccattcccacgtactgcgtgaagaccagcgccgagccgtcctcggacagcagcgtgtccagcagctcgtccagcagggccagcttgccggaccgggcggccaggcccgccgtgcccccggcgtcctccttcaggtacagcgccgggtggtcgcagatctgcttcagggacgtgaggagcttgaggaccaggccacggcggccgattccctccgccgtctcgatcgcgagcatcgactcccgtaccaccgcctcgtagagggaggcctgctcgcgggtgagcggcaccgggtggtccgtctccgtcttcggcgggagttcggggacgatgcccgggtcggacttcttgcggcgcagcaggaacgggcggaccagtcgggccaggcgctccaccgcctcctcgtcctcgccgttctccacggcccgcgcgtggcgggcgcggaaggacttcagcgggccgagcagacccggcgtcgtccagtcgaggagggcccagagttcggagaggttgttctcgacgggcgtgccggtcagggcgacccgcgcgggcgtggggatcgtgcgcagtgccttcgccgtggcggagtaggggttcttcacgtgctgggcctcgtccgcgacgaccatgccccacttctgttcggcgaaccggggtgccgccgaccgcatcgtcccgtaggtggtgagcacgaagccgccgtccaggtcctccaggctgcggtccgggccgtggtagcggcggaccgggacaccgggggcgaatctgatgatctcccgctgccagttgcccagcagggacgccgggcagaccaccagcgtcggttcactgcgcgcccgccgcagatggagtgcgatgaccgtgaccgtcttgcccagccccatgtcgtcggcgaggcagccgccgaggccgagggaggtcatcaggtccagccaggccaggcctcgcagctggtagtcccgcaggcgggcttgcagcccctcggggggctcggcgggccgcactcccgccgtcagccggtcgcgcagcaccgcgagcgcgcccgccgggaccgcctcgaccgtctccccgtcgacctccgtgctgccggtgagggcggcggagagcgcgtcgaccgggtcgagcaggcccagctcgcgcttgcgggccttgcggacgagggccgggtcgacgagcacccactggtcgcgcagccggacgacgggacggtgggcttctgccagggtgtccatctcggcctcggtgaggggatcgccgccgagcgccaactgccagcggaactggagcagttcctcgctctcgaagaagccggtgccgtcggtcgcggagccgggtgcgggccgcaccaccgcggccgcggtcaggtcgtgggcgaggtccctcggccagtgcacggcgactccggccgcgccgagccgggtcgcggcgacgccgagcagttcggacagctcctgctcggacagcgccagtacgtcgggcacgtcctgttcggcgagccggtccagcggtggccagacgcgggccgcgcggcggacggccagggccgcgtccacacgcgcgcgtggtccgaacgtcgcgtccgcctcgcccgcccacagcgccgccgcgtcgaccacgagggtcgggtcggcgaggctgtgcacctggacgacggccgcgcccgcgcggcgggccccttcgccgtcgtcgaacagctggtacgcggacagatccaggcgcagcgagacgcgtacgccggcgtccatccccgcggccacctcggcggcccagtcatgggctcccggcagccgctgcggctcgcgcgccgcgaagggcttcccggaggtgtacgcggcggccggggtgcgcggcagtgtgtccgcgaccgcgtccaggaaggacctcatcagcgcttccggctcgggaagccggagcggtcccgggcccgggagcgggacggcatggccctcgtacggaagggcggcggcgacggccctgaggtgggcgatgtcctcggggtccagcggtccggcacgccatgcgtcgaggccgtccgccgtcaggcccggcagcagccggccgcgggccacgagccgcagggcgtgcagggcggcggcgccccagcaggcggtggcggggtgggcggcggggtcacggcgggagcgggcgagcaacggcagggccgcgtcgagcggcagggacaccgcgggcacggtgcctctgcgcacgccggctccgtgcggtcgtacgaccgtgagctcctcgtcggacagcggggtgccggggagcggtggcagcggtccgcccgccggatcccagaacgcgacccgcccctgtcgcggcagcggcgcgggcaggaagacggcggccagccgcaccggcacggacgcgtcgacgaccactcccggccgcaccgcgaccgcgccggcggcgcgtgccgcaccccccggaaccaccccgtcccccatacgcccggtcacctcccgcccctgcgtcgaatcagttgtcttcgactgtacgggcggggtctgacaatcggccccggcgcctggtcgccggtcatcggcaggacccgtcagggcaccgcccgcgacaccacgtagaccatggggtgctggggatcggaccggttcaccacgatgtcctgcgtgggcgccgggtccttctggtggtggacgaggccgtaccagggcccgggtccggtgaactcccagccgacgatccgctggtcgcgggcgctgatggcgatcttgtcctgcttcagctcgccggtgttcgtgccgatgttgtcgaggaacgtgtccagagcctcgttgctggtgcggaactgggcgtacaggcggctggtcttccagttgttcgtctcgtagtaggcgacgtcactggaccaccccggtatcggcacctggtagagccggcgctgcacgcgcgagggccagcccgcggtgaggccggtcgccgagtacttctcctccttgtccttgccgctgtcgcggctctggttggcggagatcaccagatagccggccggtaccccgatgagcagcacgatgatcagcagggtcagcgcgcggcggcggatcctgtggcgtgggtcctccggggtgcgcgacggttcgtcgggcgaggaggactgccgggggaccgaggcggccgtcacggcgactccttggtcgtgcgacgggactccacgtaccgctcgtagcgctcgtagcgctccacgcggcgtcggttggcgcgccggaagcggcgggcgaccaagcgcgcgaggtccgcggcgccgaccatgccggcctcggggccgagctgggcgcgggcgatgcgggcctcggggcggtagccgcggcccgtgagatgccggcggaacgcgtcgcgggccgggccgatcagcaggtcgtcggccgccgagacgccgccgccgatcacgaagcaggacgggtcgagggcggcggcgaggttggcgattccgacgccgagccactggccgatgtcctggagcagctcgatgcacatcgcgtcgccctcgcgggccagctcggtgatcatcggtccgctgatctcggagatgttgcccttgacgtgctcgatgatcccgtacgccaccggggagtcggcggcggccagctcgcgcgcctcccggacgagcgcgttgccggagctgtactgctcccagcagccgcggttgccgcacgggcagcggtggccgccgggcacgacctgcatatggccgaactcgcccgccacaccgaacttgccgcgcttgacctggccgtcctccaggatcgcgccgccgatgccggtgcccagcgtgatcatgacgagatggtcctcgccgcggcccgcgccgaagcgccactcggcccaggcggcggagttggcgtcgttgtcgaccaggacggggaccgcgagacgtccggcgaggcggtcgcgcaggggctcgttgcgccaggacaggtggggggcgaacagcacgcggttgcggtccgcgtcgacccagccggccgcgccgatgccgaccgcgtgcacgtcgtgccggtcggacagatccaggaccagctcgacgatcgtgtcctcgacgaccttggggctcttggacttgtccggggtctccgtgcggagcttctccaggatgttgccgtccgcgtcgacgacgcccgccatcaccttcgtgccgccgatgtcgatgccgacggtgggaacgcgcggcgccgtcagatgggaacggcgctcacgggtccccacggtccgcaggacggtggcccgcgcggagccgcggtgggtgaagtcgcggtaggtgctcatcgcgccgattctgcctcacgccgcggcggccccgcatcgcggagtcccgctagtcgccgggggcggcgtccctggggtgtccgcccaggtgggtcggcgcgggagcgcgttcgagttcgtgccggaggtcgtcgagctcgctgccgcctgccatctggcgggtcagctcgtccagggtgatctcctcgcgggtgtggctgccgaacatggcgccgcgcttcaggagcacgaaacggtcgccgaccagataggcgtgatgcgggttgtgggtgatcaatacaacacccagaccggcgtcccgtgcggcagccacatatttgaggaccacaccggactgcttcacaccgagggccgcggtgggctcgtcgaggacgaggaccttggcgccgaaatagacggcgcgggcgatcgccacgcactggcgctcgccgccggacagggtgccgatgggctggtccacgtcccgcaggtcgatgcccatccgcagcagctcggcatgggtcgtccggcgcatgaagtcgacgtccaggcgcttgaacgggcccacgcccttgcgcggctcggagccgaggaagaagttgcgccacaccggcatcagcggaacgaccgcgaggtcctggtagaccgtggcgataccgcggtccagggcctcgcgcggggaggacaagtgggtgtcctcgccctcgatgcgcagggtgccgccgtcgtgccggtgcagccccgcgatgatcttgatgagggtcgacttgcccgcgccgttgtcaccgagcacgcaggagatctcgcccgcgtggacctccagggagacatcttcgagggcgcggatgttgccgtagtgcttgctgacgtcggccagctccacgagcgccgtacgctccaccgtcccggtcacttcgtggcctccgcgcgcttgcggacccaggcgttgagcagggtcgcgaggagcagcatcgctccgaggaagaacttgaaccagtcggggttccactcggcgaagacgatgcccttgctggtcatgccgaagatgaacgcgccgaccgccgagccgaccgcgctgccgtagccgccggtgatcagacagccgccgatgacggccgcgatgatgtagatcagctcgttgccgacgccttcgccggactgcacgacgtcgaacgagaacagcaggtgctggccggagatccaggcgccgagggcgacgcccatgtagaggccgatcttggtcttgttcaccgggacgccgaccgcgcgggccgcgtccttgttgccgccgaccgcgaagatccagttgccgacccgggtgcgcagcaggatccaggaggcgacggcgaccaggccgaaccaccacaggatggtgaccttgaagtcgacgccgccgatggtgaacgtcgacgcgaagaggtcgtgcgcggaggagaagccctccatgtcggagatcgacttggtggagaccgtgccgctgatcagcttggtgaagccgaggttcatgccggtcagcatcaggaacgtgccgagcgtgatgatgaagctcggcagattggtgcgggtcagcatgacgccgttgaaggcgccgatcgccagcgtgacgagcagcgagacgccgacgcccacccagacgttggcggtcatctggtagctgaacatcgacgagaccagcgccgacgacgtcaccaggacgccggcggacaggtcgaactcgccgccgatcatcagcagcgcgaccgggaccgccatgatgccgatggtcgaggacgcgtagaggaccgtgctgaggctcgcggcccgcaggaagctgtcggcgacgatcgcgaagaacacgaagaccgcgacggcgccgaccaccgagccgagttcggggcggcccaggagtttgcgcagcggcgaggtgcggagaagccgctcgtccgcggtggtggcggtcatcgcgtgccccgcttcgtgtactgctccagcttggccgcctggtccttggtgatgatctgcgggccggtgagcaccggcttgccgccgccgaggacgtcggagttgtacttgtacagccagagcaggtccaccgcctcgtacccctggaggtagggctgctggtcgacggcaaagccgagcgtgccgtccttcagctcggcggcgaccttcgcgttcaggtcgaaggtgtcgatctccgccttgctgcccgcgtcgttcctggccttcaccgcggtgtcggcgtagggggcgccgagcgtgacgagcgagtcgatggaggagtcggcctggagcttggcgccgatggaggactgcacgtcgggcatgctcgtgccctggacgtagaggttctgcacggtgcccttgaaggttttcttgacgcccgcgcagcgctgctcatggccgacgttgccctgctcgtgcaggatgcacagggccttcttccggccgcgcttgttcagctcctcaccgacggcctcgccggcgacggtctcgtcctggccgatgtgcgtgagcgcgccgaacgccttggactcctcggagcccgagttcaccgtcaccacggggatgccggccttctcggcgcgggcgacggcggccttcatcgcggcgggcttggccagcgtgacgatgatgccgtcgaccttcttgtcgaccgcggcgtccacgagctgggcctgctgctgcgcctcggcgttgtgcgagtacaggaagttgatgttgtccttgacggcggcctgctcggcgccgctctgcacgatgtcccagaacgtgtcgccatcgcccgaatgggtgatcatcgcgaaggtccatctgggcgtgttcaccgcggccttgccctgggcggacgcggccttccgggcgtcctcggcgcgcttcccgccggtgctgctgcaccctgcgagagacacgctgagcgcccctgccagcgcgatgattgcccaggtccgagtccgtgccacgaggccgtgcccttcttgccgtgatgcttggtccgtccaagtatcggacacagggatcgtgcatccggacatcgggtaccgctcgctgtgcacttcctgagccgcgccgcgcccttgcgggggacgcccccctcaggaacgtacggccggctcagggccgtacgagcagctggaactcgaaggagtagcgcgaggcgcggtaggtgtgggtgccgaactcgacggcccggcccgtgtcgtcgaaggtggtgcgctgcatcgtgagcagcggggcgccctcgggctcgccgagccgctcgccctccaccgccgtggcggcccgcgcgccgacggactgccgggcgctgtgcagcgtgatgccggcggcccgcatcagccggtacaggccggtcgcctccagctgctcgctgtccaggccgagcagtccggtcggcaggtagttgcagaggtacgccatcggctcgccgtgggccaggcgcagccgctccacctggtgcacgtcgctgccctcggccaccccgagcgcggccgcgacctcggcggaggccggcacgagggtgttgagcagcacctgggtggccgggcgctgaccggcggcctccaggtcgtcgtacaggctgctcagttccagtgggcgcttgacctggctgtgcaccacctgggtgccgacgccgcgtcggcgtacgagcaggcccttgtcgacgagggactggatggcctggcggaccgtggggcgggacaggccgagccgcgcggcgagctcgatctcgttgcccagcaggctgccgggggtcagcgtcccgtgctcgatcgcggcctccaactgctgggacagctggaagtagagcgggaccggactgctgcggtcgacgctgagctggagcgagacggtcggatccacttctggtttcggcacggcccgagcgtagctccggtgattgttgacgggaagttgtgtagttcggttgtccggacaaaccattgacacaatgcccggtccgacctcactttgttcccatgcgcatcggacttatcggagcgggtcgtatcggtacattccacgcgaccacgctcagccgccaccgcgacgtcggctcgctcatcatcacggacgtcgcccctgctcgggcccatgaactcgcggaccgcctgggcgaaaccgcggcgcccggcgtggacgagatcttcacctggggtgtcgacgccgtgatcatcacggccgcgaccgcggcccacgccgaactgatcggccgggcggcgcgctccgggctcccggtgttctgcgagaagcccatcgccgtcgatctgccgggcacgctgtccgcactgtccgaggtggacgccgccggaacgattctccagatgggtttccagcgccgcttcgacgtgggttacacgaacgcgcgggaggcggtgcgctccggccggctggggcggctgcacacggtccgtgcgatgacggccgaccagtcaccgcccccgcccgactacctcccgctctccggcggcatctaccgcgactgcctggtccacgacttcgacatcgtgcgctgggtgaccggccgcgagatcgtcgaggtgtacgcgaccggggccgatgccgggcccgcgatgttccgcgaggcccaggacgtcgacacggccgcggtggtcctcacgctcgacgacggcacgctcgccacggcgacggcgacccgcatcaacggggccggctacgacgtccgcatggaactggcaggtgagctggacacggtcgcggtcggtctggacgaccggacgccgatcgcctccacggaaccggccgggccgccgcccgcggacaagccgtggaccggcttcctcgagcgcttcgggcccgcgtacgaggcggagctggccgcgttcgtcgaggtggtgcgcggcgagcgcgccaacccctgcgacggccgcgaggcactccaggcgctgcgcgtcgcggaggcctgcgagctgtcccggcacgagcggcgcccggtgcagctcggggagatcgcgggcgggcgggactaagacgcccacgaaccgaggtcaggccccggccgtcagcaccgtgccctgggcgaccgcgcacagggcttcggtgccgtcctcggtcacggtgagcaggtcgcagcggacgacggcctggcggcggcccgcgtgcaccacctcggcgcgggccacgagggtgtggccgagagccgggcggacgtactggatggagaagccgccggtgaggaccgccgggccgagggccgcgccgcccgcgaacgtgatcgcgttgtcggcggcgtaggagaggactccgccgtgcaggaagccgttctgctggtggagttcctcgcggatgccgacctcaagcgtggccgcgccgtccccgaacgcggtgatccgcgtaccgagcagccggctgaagggctggctgtccagcgcctgctgggccgaggagaggtccagggtggcgggggcgttcatgagggcgggcctccggtgcgtccgtgcggtcggggtgtctccccgcggtgtccgcgacgacggtacgcccctaccagcgcaccgggagccgccgcaccccgcgtatcagcatgcccggcggcctggcgcccggtgggccgtcgagcgccaggtcggggcagcgctccaggagtgacctcagggccaccctggcttcgagccgggccagcggtgcgcccaggcagtagtgaatgccgtgcccgaaggcgaggtggccctggggggcgcggtggatgtcgaagacgtgcgggtccggatgacgcgccgggtcacggccggcggcgtcgagcccgatcatcaccgggtcgccctccgcgatggccgtaccgcctatctccatcgactcggccgcatagcggtacgtcgccgtctcgaccggtccctcgaagcgcagcacctcctccacggcgccgtcgaggagcgtcatgtcggctcgcagcgcggccagttggtccggatgcgtgagcagggtgtgcaccccgttcgtgatcaggttgaccgtcgtctcgtggcccgcgaccagcaggatgaacgccatcgcgcgcagctcttcgccggacagccggtcgtcgtcctccgccctggtgcggatgaggtcgccgagcaggtcgtcggcgggtgccgtggacctcttgtcatcgatcagctcgtcgaggtacgcggccagcctctcgtaggcggcgagctccgcgtcgccgccggtgggtgccacgatctcgttcgacagggctcggaacgtcacccggtcgatgtccggcacgccgagcagctcacagatgacggtgatcggcagtgggtaggcgaaggagtccacgaggtcggcccggccccgcggcagcatctcgtccagcagtccgtcggtgatctcctggatgcgcgggcgcagcgcctccacgcgccgcatggtgaacgcgcgggcgacgaggctgcgcagccgggtgtgctccggcggatcgacgaccagcagataggggcccatcagctccacgtccagcgaggtgagccccttcttggtgccgtccttggacagtctcgggtcggcgagggcggcacgcgcctcctcgtgtccgacgacgagccagccctcgaacgcctcgggcggcggggtgcgcacccagtggacgggaccccgctcgcgcagctccgcgtacaccggatacgggtcctccgtgaaccgcgcgccgtactctcccaggtcgatcacattccccatgagctcccccttccacccgtgacaacgcgcgaggcccccgcctagtgcccgtccgcctccagcagcccggcgtcgtacgtcagcagggctatctgcacccggttgttgaggtcgagcttggcgaggatgcgggagacgtgggtcttgaccgtggcgacgctcatgtacagctcggcggcgatcgccgcgttggagccgccccggcccaccgcgacggccacctcgcgttcgcggtcgttgagcgcggcgatccggtcgcgggcggtcgccctgcgcgtgtcgggggagccgcccgccgcgtggagcatcaactggcgcgtgacggcgggcgagagcacgggatcaccacccgcgacccgccgtaccgcgtcgaggagctgcgccggcggggtgtccttgaggacgaatccggcggcacccgcgcgcagggcccgcagcacctgctcatcggcgtggaaggtggtgaggaccacgacctgcggggcgtccgcgcggccccggagcagctcggtggcggcgagtccgtccagcgtcggcatgcggatgtccatgaggacgacgtccgggcgggtgcggtcgacgagttgctccacctcgctgccgtcggcggcctcgccgacgatctcgatgtcggcggcgccgcccatcatgagggacaggccggccctcaccagggggtcgtcgtcgacgaggagcagtcggatcgcagtcatgggaccaccgtagtgatgcgctacgacaatccccaccgatcgaccgcggctgtcaacggctgtcaacaattgttgacattaacagtcggcgtcggccaacgtcacagtcaatcgctgtgaggcgtaccgatcgacggagggtttcagtgcgttatcgactcttagggcggaccggcctccgcgtctccgagctgttcctcggcgccatgacgttcggcgaacagggcggggtgggtgcgccgaggccggagtgcgcgcgcatcctggacgcgtacgcggaggccggcggcaatgtgatcgacaccgccatcaactaccggggcggggagagcgagacgatcgtcggcgagctgctcaaggggcagcgcgaccggttcgtcctctccaccaagtacaccatctcgcgcgacggcgccgaccccaatgccgcgggcaaccaccgcaagaacctgacgctttcgctggagacgagcctgcgcaggctgggcaccgactacatcgacgtctactgggtgcacatctgggaccggaacaccccgatcgaggagaccgtacgggccctcgacgacgccgtgcggtccgggaaggtgctgtacgtgggcatatcggatgtcccggcctgggtggtgtcgcgggccaacacgctcgcggaatggcgggggtggacgccgttctcggcgctccaggtcccctacagcctgctcaaccgcgacatcgagcgcgaactgctgccgatggccgaggcgttcggcatgtcggtggcggcctggagcccgttgcagaacggcatcctgtccggcaagtacacccgccccggcggcctggagccgggcacggcggcccggttgccggcggaggcgatcggtgaccgcgagcgggccgaggccgaggccgtgcagtccgcggccgacgaactcggcgtctcctgcgcgcaggtggccatcgcctggacgatggcccactcccccgccgtgcacccgatcctcggcgcccgtcgcgtggagcagctcgtggaaaacctgggcgcggccgaactgaccctgccgacggaggtgttggccgcgctcgagagtgcgacggacttccgcgcgggcttcccggcggacttcatcgacgacacgtcggcatgggtgtacggcacggcggggcatcgggtggtggggcgcgccgggtgaggcccccggaggggcgggcgctcggcctcgggctcccgcacggccgaactcgggctcccgcacgacgccccgggccgggctgttcggcctcccgccgccccgctaccggggatccggccccggccccggccacggcagccaagcccgcagcccgaacccgccgtcgccctccgcaccgtggtcgagtcggccgcccgccagggtcgcgcgttccatgaggccgatcaggccctgaccggagccggggacatggggtacgtcgcccggcggcgcgggattgcgcacggagacggtgaggccgtcgcccggggcgcccgccacggtcaccgtgacctcggcgccgggcgcgtgcttgcgcgcgttcgtcaggccctcctggacgatgcggtacgcggtgcggccgatggaggcggggaccgcggcgggggcggtcacccggtggtcgaggacgatcttcataccggcctcgcgggactcggcgaccagcccgtcgagggcggcgagcgtcggttgcgggcggcccgcgtcgtcggcgtcgcccgcccgcagcacgccgatgatctcccgcaggtcctgcaacgcctcgtgcgcgctctcccggatcaccccggccgcccgcgcgatctcctcccggggcgcgtcggggcggaactccagcgcgccggcgtgcacgctcagcagcgtcagccggtgggcgagcacgtcgtgcatctcgcgcgcgatggcctccctggccagccgctgcgcctgctcggcccgcagctccgcctccgtctcggcgcgccgcgcccggtcccgcagactcagcacgagctgccgcttggatcgtacgaacatcccccagccgaccaccgtcacggtcagcagcccggcgacggccacggcggcgacatagggcagatcggggtccgggcgcagccagtagacgcccgggagcagcgcgagctggatgccgccgacccacgcgacgtaccggaagggcaggtgcacggcgagggtgaagagggcgatcaggcccgcgccgcccgcggtgttcgagatcagcccgaccggcatcatcgccacggcgagcccgagcggccggcggcgccgcagccacaccgccgcacaggccgacgcgccgagccattggtcggcgacggccaggccgtgcgggatgtcgtgctcccgggtcaccgcctccgcggcggcgatcccgatgaccacggccagcaggacgcagccgaggtcgacgatccagtcccgcacggtacgccgcggatgccggccacgctccgcgccgccggcgtccagcgctgcgatcacggcggacggcaggaaccaccgctgccggggcagcccgtacgacagcggcacggccggctccggcagccccggcggccgcgggccggaccgagccggcaccatccgctcgaacacggcccggtatgtcgacgcccccggggaaggcgccggcttgtcactgctcacggtcgacaaatttacgcagggacggccgccggcacctccccgccgacgcgaccgacgaccaaagtcgtccactcgaagactttcggcgcggctgcctgcggggaggccgcggcttcggacggacaggcctcgccccgcggccggtgagcgtggggggtccgcggggcgagggtcttcctgtgcaggcctccggcctggtcgcgccgttcctcgagagccggacgtcggctcagcacatcggctcagcacgtccactcagcacatcggctcagcgctcgacgtgtgactcagcagtcgaagtcgatcaggtcgaacgtgacgtagtggtccgaggtgtagtagtcctcctgggtctgcttgcccgtgacgatgcggcgggcaccgcgcgtcgaggagccgggcgtcttcacggtgtactcgtggtagtagccgctggactgcgtgggcaggacgccttcccggttctggaagacggccccgtcctgcgagtacgggaaggggccgttcgactcgatcagatcgagcgtgtcgtacgcctgggacggcaggtcgctgtagcagatgctgccgaccgaggcggccgtggcatccgcggtcgtcgcggagaccgtgccgcccacgagcagggcggacaggagcgcggctgcggcgctgatacgagtgattcgtggggggaatctcatggctctagaatgacgcgcgtagaccatgacatgtcaatgtcaaggcaactgatttctcccgccgagtccgttgaattttccgggagttaacctgccgcccggcgcccccacgcggtccccgcgaggacgagaacgccccccatcagccccaacgcgccgagacgttcgccgccgagggtgatccccgcggcggcggcccacagcggctcggtgccgagcagcaggctgacccgggacggcgaggtccggcgtacggcccacatctgtacgcagaacgcgaagagcgtgcagaacgccgcgaggaagagcagcccgccccactcccgcgccccgaagcccgcggccgtgccccacacggtcgcgtcggtgccggtcgagagcaccgcgaacacggcgaccgcggcacccagttggaccgtggtcaggggcagcgcgtcggcgccctgaacggacttgacgcgggacatggcgagcacgtggacggtgcgggcgagggccgcgagcagcatcagcagatcgccgagcgaggggcgggtgaacccgccgccctgggtgagcagcacgacgccgagcacggagaccccggccgcggcgaggaaggcccgcgggggccgcgcccgggtcacggccgcctcggcgagcggcgtgaagatcatggtgaggctgatgatgaggcccgcgttggtcgccgaggtgtggacgacgccgtacgtctccaggaggaagatcccgctcaggatcagccccagcagcgccgccccgcgccactgcgcggcgctcagcgcgcgcagcgaacgccgtccggcgatcaccagcacgggcaggacgacgccgaagcgcagcaccaggacggcgatcaccgtccgcgccgtggtgatgtccttggccgcgagatagctggctccccacaccaccgcgacgagcagcacgggcaggtcggtgagccaggcacggcggggcgcgagcgcgccgggtacggcgatcgacgacatgggagcggtctccagcgggcggacgggcgtggagacgtcggcggctctcacagggaacgatcaccgtaccggcgaggatgcgtgagggctacacggtttcggcggacgcttcggcagcggacgcttcagtagctgccgtacgtcggacggcccgcccgttcgtacgtgtggatcgccacgcccgcgcccgtggtgctgccaaagacgtgccggaacgcggtggggacggcgccctcggcgaacaggcggcggccggcccccagtacgaccgggaaggtcagcaggtgcacggtgtcgatcagatcgagcgcgaggagggaccgggcgagggcaccgctgccgtggacctggagctcgcgggcggtgcgctccttgagggcggcgacctccttggcgaggtcgccgcggatcacggtcgtaccggaccaggcggggtccgtgaggctcgacgaggcgacgtacttcggcagggagttgagcttggcggcgatcgggtcggcggggtcggtgaccttcggccagtagccggcgaagatctcgtacgtgcgcctgccgagcaggaaggcgtccacgcgggcgaaggcgtcggtcacgaaccgtccgaagtcctcgtccccgtacgggacgctccagccgccctgctcgaagccgtcgctgcggtcctcctcgggtccgccgggagcttggtggacaccgtcgagggtgacaaaagcggtgagggtgagcttgcccatgacagctgccttcttccttcggtggggtccccgtcctcaggacagaccccaccggcacccgtgactcatcggtcccccggaaaccggcgaggggcggggacacggcgctgtgcgcggtcagccgttcgcggggccttcggcggtagtgtgccgatggacgttgcagtgccgcacgacgccatccacggtgaggggcgatgatcgtttcggtggtgtcgatgccggagggcgtcgtcgctcgcacggggctgacacaggcccgggagcatctcgcgtcctcccgtttcgtgatcgtggacgtcgaccaggaagaagaacccccgctcgacgacgagccgctctcccgtcggctcgggctggatgacgcggcctggaagtggctcggcagaccggacgagcacgtccgggtcgagtaccacgcgggcacggccgccggcgtcgtgccggtggtctgcggcaaccaggtcatccacatccacgtcctggccggcgatcggcacttcatcacgattcatcaggggcccgtcgaactgatcgacaccttcatcggccagttgccgcaggaccggccccccgacgcggtgacgacgctgttcctgtttctgcaaggggtcctggagacgtatcgccgggccatcacgcaggcccatctggaggtcgaggacctcgaggaagcgatgttcgagcaacggcagccggagcaggtccgtcggctggcccagctgcgacagcgcgcggcccacctgcaccgcgcgttcctgccctacgccgcggtcgcgcaggagatcctcgtacgtcgcaggatggcggatcacgacctctcggcggaacggcaggcgatgaaccgcctgcacgagcacaccgtgcagctggtgctcgtggagatcgaggcgctgcgggacgcggcccggcgagccgcgagcagctacgcgtcactcatcgccgatcagcagaacgtcgtgatcaaccggctcaccatcgtctcgatgatcttcttgccgctgtcgttcctgaccggattcttcggcatgaacttcgccttcctgaccaaccggctcacgagcgaggactccttcctggagttcggcgtgggtcttcaggtgggtgcggtgatcgtcgccctgtactacgtgctgtaccgcacccactggcgtcagctgcgcgacagccgggcccgcgacgccgccggcgacgaccagccctgactccgccccggcggggcgccacgaggcagcacggccctcagccgccgagctcctggtacctggccgtcaggcgcgccgcgccctcctccgtcagggagccgaacaggcgcaggcgggagatgcctccgtccgggaagatgtccacgcgcgcgtgggtcccggccaccggcgcggccagggtgaagcggtggttggtgtcgggctgcaggcgggtgcgcgggaggatctccgtccactcgccgctctcaccgtccttcaccgacaccgccgcccacccggcgctgttgcccttcaggtacgccgtgtcgatctcgatcgcgcggatctcggaccgggcgaccagctggtagcggatccagtcgttgccgtggtcgcggcggcgccgcgtctcccagccgtcgtccatctggcgggagcggcccggctggatcgtgttcgtggcgggtgagtagaagaggttcgaggcgtcctcgacccggccgccgttctcgagggccacgacgtcgaaggtgcccagcgccgccagccacacggggtccggcacggcctcgccgtacacccgcagacgggcgatgccgccgtcggggtgctggttgacccgcagatgcgtgaagcgctgctccaccgacacctcgaagccgttcgccgcgtggccgccgaccgccgtgcgcgggacgagcgtcatccacttcacgtcgcccgcgaggagttcctccggggacggggacccgggtaccgaggcgccctcgaccgacaccgcctgcgggtagttgccccggaagtgggccgtgtcgacgacgacgccgcgtacgacgccgggcgcgccgagacgtacgagcgcccagtcgtggtcctcggccgtcggccacgggtgtgcggccgaggcgccgcgccggcggcgggtctcccagccgtccatgatcttgcccttgtgcccgaagtgttcggggtcgaactcggcgcgtccggccacgaggaggttctcgcgctgggcgaagaactcgtcgttggcggcgatgacaccggcgccgagctgccggtcggcgaggttggcgtactgggtgaaggggaagtcggcggtgcggtagtccgcgtacgggtcaccgcctccgtaggggttcgcgtcgccggtgaagcgggccgaaggggatggatgctgcgccgtcacggtgatcaggtctgcctctcgggagtcggccactgcgggtgcggaggaggattacgcggggggggcggactacggttccctgctgaggagccggcccttcggctccgtgaactcgccgtcagccatgatgcgttcgccgcgcagccaggtggacttgacgacgccgctgagggtcttgccggcgtaggcggtgacccggttgcggtgctgaagtgccgccgggtccacggtgaaggtctcgtcgggcgccagcaccgcgaagtcggcgtcgcggcccgcctcgatggcgcccttctgggccaggccgacgagccgggccgtccgtgcggacatccagcggacgacgtcctcgaggctgtggccgcgccgccgggcctcggtccagatcgcgggcaggctgagctggagtccggagatcccgccccacgccgtcgcgaagtcatcggtcttcaggtcggcggtggagggcgagtggtcggtgaccacgcagtcgatcgtgccgtcggccagcgcctgccacagcaggtcctggttggcggcctcacggatgggcgggcagcacttgaactcgctggccccgtccggaacttcctcggccgtgagcgtgaggtagtgggggcaggtctccaccgtgacgcgtacgccctcggccttggcgccggcgatcagcggcagcgcgtcgctcgacgacaggtgcagcacgtgcacgcgcgcgttgaggcgcttcgcctgcgcgaggaggttcgcgatagcggtgtcctcggcgtcgcgcgggcgcgaggcgaggaagtcggtgtacctggggccgccccgctggggggcggcggcgaggtggtgcgggtcctcggcgtggacgatgagcagtccgccgaagccggcgatctcggccatcgaccgggccagccgctcctggtccagctcggggaactcgtcgacgcccgagggcgacaggaacgccttgaagccgaagacgcccgcgtcgtgcagcggccgcaggtccttgacgttgtcgggcagtgcgccgccccagaaaccgacgtcgatgtgcgccttgtcggcggccacgtccctcttggtgcgcagattgccgaccgtcgtggtcggcgggagggagttgagcggcatgtcgaccagggtggtgatgcccccggcggccgcggcgcgcgtcgccgtccagaagccctcccagtgggtgcgcccggggtcgttgacgtgcacgtgggtgtcgaccaggccgggcagcagcacgtcgtcgccgaggtcctccaggcgggcgccggccggcacctcggcgtcgtgcggcagcaccgccgtgatcttccccgcggcgaccgcgaccgcggcggggcgcgtcccctcgggagtgatgacgcgcgtcgagcgcagcaccagttcgacgtcggacacccgggccccttccatgccgctgtttacttccgcgtaacgaaattcaacgttctgttgaaggagtcttcacccacggccccccaccgtcaagagtgaacctctccaccccaccctcgacgcacccagcctggacgtttccacaaagcggaattatagtttcggtaggcagaatgtaactacgcacaaccggagagtcaaccgaccgacaggtaggcttcagctcttcctgaccacccgaaaggaacgcgccgtgccgacgtccagcgccagcaccaccgactccgccaagtcgcccgccccgagcggtggtgtccagtccctcgagcgcgccttcgacctgctcgaacggatggcggacgccggtggcgaagtcggcctcagcgagctgtccgcgagcagcgggctgcccctgccgaccattcaccgcctgatgcgcaccctcgtggcctgcggttacgtacgccagcagcccaaccgccggtacgccctcggcccccgcctcatccggctcggcgagtccgcgtcccggctgctcggcacctgggcccgcccctatctcgcacgcctggtcgaggagaccggcgagacggcgaacatggcgcttctcgacggcgacgagatcgtctatgtcgcccaggtgccgtccaagcactcgatgcgcatgttcaccgaggtcggccgccgggtgctcccgcactccaccggcgtgggcaaggcactgctcgcgaacacgccggcgaacgaggtgcgcgcgctgctggcccgtaccgggatgcccgccgccacggagaagacgatcaccactcctgacggcttcctcgccgcgctcgaagaggtgcgccggctcggctacgcgatcgacgacaacgagcaggagataggagtccggtgcctcgcggtgtccgtaccggactcgccgaccgccgcggccatctccatctccggcccggcgggccgggtcaccgaggaggcgacggagaagatcgtgccggtgcttcagcaggtggcggcggagctttcggaggcgctggcgacttcggggccgacggcctgacccgatctcacggcccggccccggcccgggaccgacggcggggccgggccctcaccagcccggctctcgcaccgtcatggagcccggccctcccatggcaccgtcttggagcccgtcgccacgccgggcatgaggcacgcgccgggcatgaggcacgcgccgcgcccggcgagcggcggcggcgcgggccggccggggagccgatcacgccgcgcgccgaatctcgtcggtgccgagcaccgcgcggccgccatgtggaaccgtcctgatccctcggacggacctgagcccgccctccgcgcaggcgacgggaaggtgacgacagggcctagccgcgcctcggtggttccccgaacagctccaccgcgccgcgtacgtccgcgaggccccgggccagcgcgctgaccgagccgatcgcgccggcgatcagcagcagtgagcggcgtaaccgcgggatctcggggactccgccgacggccatcgccgccagtgcggccagttcgtcctcggcgatgccccggtcggggaactcgacgggatgcgcggcgagttcgcggcgcagccgggacacggcggtccgcagccctgccaccctcgggtcctcgtcgctgccggtcactggcctctgccccaagctccgcaacacagctctccccctcgcacgccgttgtgcgaatgtccttcgtacgtcgctcagttccccgcgccgacgatgggcgccggggaaccgggtcagtaaacgccacccggtgtggtgggcgccactccgaggaccgaaattcagtccatggacatcacccggtccgcgcgggttcgagcgcacacccgagccgggtcgggtatgcagggggaatgaccgagaacgaggacctggtggcggggctcctgctggcggccggtggcgggcgtcggctcgggggccggcccaaggcgctcctggaacaccgagggcgcccccttgtcgaacatgtggccggagtgctgcgggcggccggatccacccgcgtgtatgtcgtcctgggcgcccaggccgccgccgtacgggagcgcgcggtgctgcccggctgcatcctcgtggacaacccggactgggagctgggcatgggcacctccctgcgggccgggctggaggcgatgcatggaacgggggtacgcgccgcgctggtgtcgctcgtcgaccagccggggatcggaccggcggcggtggcccgggtacgggcggcgtacacgtccccctcgaccctcgcctcggccgcgtacgacggagtgcgcggccaccccgtcctgttcggcgccgcccactgggcggccgtcgccgcgagcgcgaccggcgaccggggcgcccgcgcctacctcaaggcccatgagtccgcgatcacccttgtcgagtgcggggacgtggccgaggcgtacgacatcgacacggtcgccgacctcgtccacctggagtgaacggggtggcactgagcgccatcttctgtcgactctgagaatctcgacatcaacaaaccattgaacttccaccatgaggaaactactatccactgttcagaagcgccggaccgctcccgaggcgcccccagccgcatccgcggcccctggcacccggtgccgcgtcgacgcgcgcacgcgcgcggtccgtatccgtagctcgctgaaggaagtgacagctcatgtccgcaccagcgccgtccccgctggccctcgtcgacgccgagcccctgccccggcaggaagaggtcctcaccgacgcggccctcgccttcgtggccgagctgcaccggctgttcacgccccggcgtgacgagctcctcgcccgtcgcgcgcagcgccgcgccgagatcgcccgcacctccacgctcgacttcctcccggagaccgccgccgtccgcgcggacgagtcctggaaggtggcccccgcgccggccgcgctgaacgaccgccgcgtcgagatcaccggccccaccgaccgcaagatgaccatcaacgccctcaactccggcgcgagggtgtggctcgcggacttcgaggacgcctccgcgcccacctgggagaacgtggtcgtcgggcagctcaacctgacggacgcgtacacgcggaacatcgacttcacggacccgaagtccggcaagtcgtacgccctcaaggcgaatgaggagctggcgaccgtcgtcatgcggccgcgcggctggcacctgaacgagcgtcatctcgtcgactcgcagggcaggcccgtcccgggcgcgctcgtcgacttcggcctgtacttcttccacaacgcgcggcgcctgctggacctcggcaagggcccgtacttctacctccccaagacggagtcgcacctggaggcccgcctctggaacgacgtcttcgtcttcgcgcaggactacgtcggcatcccgcagggcacggtccgcgccaccgtcctgatcgagacgatcacggccgcgtacgagatggaggagatcctctacgaactccgcgaccacgcctccgggttgaacgcgggccgctgggactacctgttctccatcgtcaagaacttccgtgacggcggcgccaagttcgtcctgccggaccgcaacgcggtcacgatgacggccccgttcatgcgcgcctacaccgaacttttggtccgcacctgccacaagcgcggcgcgcacgcgatcggcggcatggcggcgttcatcccgtcccggcgcgacgaagaggtcaacaaggtcgccttcgagaaggtcaaggccgacaaggaccgcgaggcgggcgacggcttcgacggctcctgggtcgcgcaccccgacctcgtcccgatcgcgatggcgtccttcgacgcggtgctcggcgacaagccgaaccagaaggaccgcctccgcgaggacgtgtccgtggcgcccggcgacctgatcgccatcgactccctggaggccaagccgacgtacaacgggctggtcaacgccgtgcaggtcggtatccgctacatcgaggcctggctgcgcggcctcggcgcggtcgccatcttcaacctcatggaggacgcggccacggcggagatctcacgttcgcagatctggcagtggatcaacgcgggcgtcgagttcgagaacggcgagaaggccactcccgagctggcccgcaaggtcgccgccgaggaactcgcgaacctccgcgccgaactcggcgaggaggccttcgcggccgggaactggcagcaggcccacgacctgctgctgaaggtggcgctggacgaggactacgcggacttcctcaccctgcccgcgtacgaacagctcgccggctgagcggtcacctctccgagtggcccagggacttctccggggccactcggtcgcgtacgagccgcttcacggccgtcggctccggaaagccctgctcccgccggtcccataccacctcgtcgtccacgcggacgacgaagacgcccccggtgcccggcttgagcgccagctccgtcagctcggtctcgaacgtcgtgagcagttcctgggccagccaggccgcccggggcagccagcggcactgggtgcagtactcgatctggacgcgatgagtgtgcggggtggtcatccgaggtgcaccgaccaatcctgttcagccgccggtttgccgtgcaggtccgggacccgtttgagccagttggggcggcccgcccgggtcttcgccgcgcgatgggcgtcctcggcggtgagttgttctcgggtggggaagtccgtggggagccaggtcccggaggccctgacgcgggcggcgaggtagccgacgtaggcggcgcgtacgtcgtcgggggtgtcgaagcccggttcgtcggccagccaggcgtcgggcacctccgccagcacctcacgcagcagctcctccgtcacccggggtgccagctcggcgtccgcggcacgggtgtcgggggcgtaaccaccgagcgcgtgcgagcggaagtcgtacgccttctccggggacgaggcgtcccaccggtggtggaagacgagggcggcgccgtggtcgatcagccacagcctcgggggcgcgatgccgaacgtgggccagatcatcaggttcgagctgtgcaccgtgcggtcgacgttcaccgtgagggcgtccagccagatcaccttgccggcctccagcgggtcgacgtcgaaggtcttcgcgatctccggggtgaagtcctcggcgcccggcaggtagtccatgccgagattgactccggcgctggcgtggaggaggtcctggacctcctggtgcggctcgtgctcggcgaccgtcgggtcgaagtggacgaggacgagctcgggaaagcgcagtccgaggcggcgcgccagctcgccgacgatcacctcggcgaccagcgccttgcggccctgcgccgaggcggtgaacttcacgacgtaggtccccaggtcgtcggcctcgacgactccggggacggagccgcccgcccgcaacggggtcacgtatcgaacggcagtcacttcgcgcagcacaccggccactgtaaaacagtcgctcacccgagtgatcggatttatgcgcgggccagggggttgggcagcggcagatagcgggcgtccgcaccgtccgcgcccgtccaccgcaggaggaggttcgtcttgccggggagcgtgggtgaggccagcagttctccgacttcggggaggtcgtggcgcgccagttcccgtcgtaccgccggccacgggtccgttcccggccggcgttcggcgagcagggccgcgagctcggcgaggtggttgacgaccaggcagtacacgagccgctcccagccggccgcccggctcacgtcgggcagcagcttcaccccttccgcatcccggaagagcgcctggacgggcatgccgtcggcgtccacggcgaccagcgtgttctggaggtgcgcctcgaggacgaccccgtggcgggcgaacgcgtccagcaccggcggcaccacctggcgcagatacgccgcccaccaggccctcggatcgtcgagccggtcgagcgggttgccgtcgaagccctccaccagggcggccgcgaggagcggggtggtaccgggcaggagatggggggcgagcccgtcgcggacgaggacggccagttcctcgaaggcgaagccggcggtgcggtagccgcggtcgctcagccacgccgcgggcccgcgcgccgcggcgaaggcgttcgccgccgcctcgtccgtgcggcggagtttcagcaggtcgtggcgccacagccggcgtacgtcgttggtgatgcgcacatcgaggctgaacttcaggaagaggtccgcctcgggcgcgtacagcgtgcggacggcggccgtcggccagacggcacacccggtccggccgagccgtacgaggcggccgtccgcgaaggcgtcgcggatctccgggcgggcgccgaccaggtccagctgccagggatgggcgggcagcagccggtagccgggcggggcctcggcgagcgcgtcgagcgccgtggtgtcgccctcctccacgaccgtgtccgcgcgcacccccagcaggaccagcgggaaacgggcgtacgcctcgggcgcgtagggcagccatccggtgacggggccgccgccgcgggccttgggcgccggatggtggggatggccggtgatcagggactgttcggagcgcagatacgggtcgtccggcggcgtcgcgcgggcgcgcgcgccgagcagcgcggccaccgcgtcccggctgtcgaccatctcgccgggcagctcggaattggacagaccggtgccccggcgcagttcctcggcgacgagtttcaccagctcggcatgggtcagccggtgccaggcgccgcctgcgtacacctcggggtcgcgggggcggcggtccccgcgtacgcgcagcagcctgccgccggagcgcagccggtacacgccctgatcgccggcgggttcccccatttcccgcagcagacagttcagcagcggcgcgtccgcataggcgtcggcggccggtccgacgtcgtccccgggggacatcgggatcatggggtccacgcgatccattcgttccatacggtccatccggtgcactggcgatcagtatgtctgtcgtcgtgtgccgccgcgacgccgtacccgtcccccgaggagcccgaccgtgcaccgtcccgccaccgcagagtccgagctcgccgccgagctcgacgccgtacggcccggcctgtcggcgccgtacgcggccgcgctcccgggcgcccgtgcggccgtcctgacccggctgtggcgggcgctggcccatgagccgctgccgtggatcgcgcaccgggagccggagcccggcggactcacgctgcggctggccgacggacgccggctgcacggcccgccctcggacccgtacgcgaccgctccgtacgtcaccggcgtgcggctcgacgagacgtcgtacgcgcatccggcccggctggtgtcggcgctcggcgtcccgcacggcccggccctggccgccgaactcgaccacagtgtcgcctcgttggccctgtcgcgggccggtcagccgcgggtcgacccgaagtcgccgacgacgagctgggagtgggaacagcgggtggtcgacgggcatccgttccaccccaactgccgttcccggcccggcttttcggccgccgagcagctcgcttacgggcccgagcaccggccggtggtgcggctgggcctcgtggccgtggaggagtgtctcgtccggggcgagtggcccaagtggctgcgggacggggagcgcgtgctgattccggtccacccctggcagacggcacacgtgctcgacgcaccggtggaggacgggccggccgcccacccgctgatgtccttgcggaccctcgcgctccgcgacggcggcccggacgtcaagaccgcgctcagcgcccggctgacatcgtccgtgcgggacatctccgtgtactcgatcgagacgtccgcgacggtgtcggagttcgccgaggccttcgccgcccgcacggacggcctgctgcacatcacccgcaccctgggcgcggccacggccggccggcccgagctggccgcggtggtacgcgagtccccggacacgtacgccgacgcggaggcggcggaacgtgtcgttccggtggcctcgctcaccggtaccgggctgcccggctctcccgcgtggctcgccgagttcacccggctcacgctcaccgtgggtctgcggctgctcgacctgggcgtggccctggaggcgcacggccagaacctcctggtggtcctgtccgccacgggtgccccgctgcgcctcgtgtaccgcgacctcgccgacatccgcgtcagcccggcccggctggcccggcacggtgtcccgctcccggatctcggcgggcgtctcgtcacggacgacgaaaccaccctgcgccgcaaactgttcggctccctcgtcgcgggcgcgctggcggcgacggcggggtcggggccggcgctgcgggaggcgctcgccgccgcggcgcgggatctgccgcgcacccccgatctgacggcgctgctcgaagagccgctgccggccaaggcgttgacgctgatgcggctgtcgcccgaccggccgggggacagctgggcacagctgcccaacccgctcgtcacgcgcgcgttctgagaccggagcccgctcgttttgaagcccggaccctttgatcaataggatccgccgatgatcacaagacaacggctggcggtggggctctgcgctctgctcgccgccctgacggccgggttcgccttcccggccggcgccgtcgccgacgagacgacagccgacgcgcccaaggtggacctcgtcctcgacgtcagcggttccatgcgggcccgggacatcgacggcggatcccggatggccgcggcgaagcaggcgttcaacgaagtgctggacgcgacgcccgaggaggtgcggctcggcattcgcacgctgggcgccaactacccgggcgacgaccgcaagacgggctgcaaggacaccgcgcagctgtacccggtctcgacgctggaccggaccgaggccaagacggcggtggcgacgctctcgccgaccggctggacaccgatcggcccggccctgctcaaggcggccgacgacctcgacggcggcaccggctcgcaccgcatcgtcctcatcaccgacggcgaggacacctgcgcccccctcgacccgtgcgaggtggcccgggagatcgcggccaagggcgtcgggctcaccatcgacaccctcggtctggtgccgaacagcaagctgagcaagcagctcagctgcatcgccgaggcgaccggcggcacgtacacctcggtggagcacaaggaggacctcaccgacaaggtcaaccagctggtggaccgcgccgccgacaaggtggtgacgccggtcgccgtggacggcgccgccgactgcgcgaaggcgccgacgctgaagtccgggctcttcacggaccgtgcggagttcgcccagcaccgctggtaccgcgtggacgtgaagccggggcaggagctgcgcgcctcggtgagcctctccgccgaccgtcaggtgaacccggactacggggtgttgctgcgggcggtgaccgtgcacaaccgtgagatcgtccgcggtgaggccgcgggcacgggccgtacggacgtcgtgtcgacgggtctgcgctatccgaaggccgagagcgacgacgaggacgccaccgccgagacggtgtgtctccaggtctcccactccttctcgccggccgccggcgtgaagaccacgcccggactgccgctggagctgaccgtcgacgtggtggacggacccgaccaggcgggcgacgtggcctcgttcggcctcgggcgcggctggtggctgctcggcgccctggtgctgaccggcttcctcgcgggtctgctgtggggctggctgtcgcgctggcggttcgcggtctggaggaccaactgatgcgtatctcacgtgtactgaagtcaggtgtccggaactcgggtgtcctggtcgcggcgggtctgctgctcggcgccgccgtggcaccggccgtcgccgactcctcgccgtccgcgagcccctccggggacagtgccgcgcccacctcggcgggcacctcgttccgtaccgcgaccgagatcgcgcaggggcagcgggccacggccggcggctccgcgggcgactacctgtactggtcgttccccgcggacaccggtctgcggcccaccgtgaaggcgacggtgaagttcccgcagtccgccgagcgcggcgcgagccagacctggcagctcgacgtctacgacgggctgcggcgccgccaggcgtgccagtacggggcgcagacgcggacggccgcccaggacgcgacctccgtcgacctgtcctgcacgctgcgcacggtccgcgcgtggtcggagccgtgggccgatgatccgctgccgggcacgtactacgtccggctgaccctggtcgacgtggcgacgggcgacctggggctgccggtgagcgcggaggtccaggtggactccaaggacatcggcggttcggcggcggtcgacgggtcgctgtcccagccgctggtgccggggatcgcgacggcctccgacacgtcggacgagggatcggactcggccaaggcctcgctgttctcactggagcccgacgacggctgggcctccggctggtggaccgaccgctgggtgtggacggcgatcggcggcatcctcgcggcgctcgccggaatcggcgggtacgcgctgacgaagggctcgggccggcccaggcaggtaccaccgggcgcgtgacggacgcgcgcgacaaggcggaggcccgccgtgccccatggcacggcgggcctccttgtgcgtgcgggtgcggggcgggtgacccgtgcgggggcgggcgaccgtgcgggggtgggtgcgcgtgcgggggtgggtgcgggtggcccgtgcgggggtgggtgcgggtgcgcggggccgcaagggcgggtgcacgggggccgtacgggggccgcgcggacggcgacccgcaccagacggacgggagacggcccgtgggaacaggcggacggacggccgcgcgggacgaacgggcgacggcggcccgcgcaggacaggcagccgacggcccccaccagacggacgggcgaccgcccgcgcgagaccgacgggcggtgtcagtcgccgcgcagcagcttggcgagcgcgctctcgcccgtgatctcggcgcggccctcccgtacggcctgatggagcgtcaaagtctcacggctcagggccatacaggtgtccgcgtcgatgaccagacgcgcgtcgggctcctcgggggccggtccctcgccgtacgccgggccctccgccgcacccaggtgcagatggaaccgcccttcctccaggcggatttcgagcaggccgacggcaaggccgtccccctccagcgagcgcagcaacggcagcgcgaaccagtgcgcgcgcaccgcgtccgtggcccggcgctccgccagcgcgggcgcaccccagctgcccagcgcctggagaacgggcagcaactcacgcccgcgcccggtgagttcgtacacgtacaccgcacccggcggcggcaaccggcgccgggtcgtcagcccgtcgcgctccatgtccttcagccgggacgccagtacgtcggtactcacacccggcaggtccgcgtgcagatcggtgtagcggcgcgggccgccgagcagctcgcggacgatcaggagggtccagcggtcaccgacggcgtcgagggctcgggccgcggaacagtactggtcgtagcttcggcgaggtggcatgcgacgcagtctagacatgttgttggactttccaagctctgacttggtaaaaccaagtaacaccacgaaccggagggcacagcgcatggagttccggcagtcgagcaagctcagcgaggtctgttacgagatccgcggcccggtgatcgagcacgccaacgcgctggaggaggcgggccacagcgtgctgcgcctgaacaccggcaaccccgcgctcttcggcttcgaggcgcccgaggagatcctccaggacatgatccggatgctcccccgggcgcacggctacaccgactcgcgcggcgtcctctccgcccgccgcgccgtggcccagcgctaccaggaccgtggcctggaggtcgacgtcgacgacgtgttcctgggcaacggcgtctccgaactcgtctcgatggccgtacaggcgctgatcgaggacggcgacgaagtcctcatcccggccccggacttccccctctggacggccgtcaccacgctcgcgggcggcaaggcggtgcactacctctgcgacgagcaggccgactggtacccggacctggcggacatggccgcgaagatcaccgaccgcacgcgcgccgtggtcatcatcaaccccaacaaccccaccggcgcggtctatccgaaggagatcgtcgagggcatcctcgatctcgcccgtcggcacggcctgatggtgttcgcggacgagatctacgaccagatcctgtacgacgacgccgtgcaccactcggccgccgccctcgcgcccgacctggtggtcctcaccttctgcggcctgtcgaagacgtaccgcgtggccggcttccggtccggctggctggtcgtcacgggccccaagcagcacgcccgcagctatctggagggcctgacgatgctcgcctccatgcggctgtgcgcgaacgcccccgcccagtacgcgatccaggccgcgctcggcggccgccagtccatccaggagctgaccgcaccgggcggccggctgtacgagcagcgcgaccgcgcctggcagaagctcaacgagatcccgggcgtctcgtgcgtgaagccgaagggcgcgttgtacgcgttcccgcgcatcgaccccaccgtgcacaagatccacgacgacgagaagttcgtcctggacctgctgctgcgggagaagatccaggtggtccagggcaccggcttcaactggccccgccccgaccacttccgcatcctcacgctcccccacgcggacgacctggacgcggcgatcagccggatcgggcggttcctgagcgggtaccggcagtaagaccgtccggcacattggggctgtccggcgcagtagggctgtccggcgcagccggacctgcggccggcacccggcggtgtcaccgtacgaagggacagaaagggtgtggcgatgggtgaccttctcctcgtacggcacggtgagaccgagtggtcggtgtccgggcggcacacggggtcgaccgacattccgctcaccgagaacggacgggagcaggcgcgcaggctggctccgctgatcgcctcgcaccacgtcggggccgcgttcgtcagcccgatgcggcgggcgcgggagacggcgcggctggcggggctcgacggggcgcgcgtcgacgcggacctgagcgagtgggactacggcgggtacgagggggtcacgaccgtcgagatccaccggacccggcccgactggttcctgttcacggacggggtcgagcccggcccgccggagcaccccggggagagtccggaggaggtcggggcgcgcgcggagcgcatgctggccaaggtcgacgcggcgctcgccgacacggagggcagtgtcgtcgtggtctcccacggtcacttcctccgcgtgctggccgcgcggcggctggggctgcccgcctcgggcggcgccctgttccagctcgcgaccggaacggtgagccggctgagcacggagcaccgccgccatgtggtggccagctggaatgtcagaccctcctcgtagtcttcaagtgggccggtcagcaggccgcccgccgagaggacgaaggaaggagcgccgccgtgacccgaccgccgaccgccgcgcagcggcgcgtcatcgaggccgccgatcccgtcaccgggcgactgaaggggaccgaggcccagctcgccgccctggtgaagcgaggactcgccttccggcatccgcggccgccgcacgaccactttctgacgcccgccgggcatcgcatacgtgaagctcccgagccggtcgtcgagacacccgcgccggccgaggccgggtccggcgtgttcgccgcgcggatcggcggcgaggagggcgaggccggcccttcccgcctccgcgaggtgcacagtgcctggcaggggctcctggagttgcgccggatgaccagcccggacggtgccgtcgaccgtccgtgcgggtgggagcgtgcgcatctggtgcaggccgccgcgctcgcgctggaggccgcggggcaccggccggcaggcacggacggtggtgggtaccgggtgcgcgcgactccccagccggaggcggtcgcggtacaggagccggacccggaggcgttgcgcgcctgcgcggccacgctggagaaggcgggctggcaggtcggcgagcacgcggagccgcgcacgggggcgcggtatgtgctggcctcaccgaggcgcgtatgaggtctcgccccggcggcccgaagcccgaagcccgaagcccgaagccccaaagagcctacggggcaagggaattggagatccctcgctcactagtgctccgttagtgttgcgtccgtcctgatcgtcgtagagggggaagtcgtggcagagccgttttccgtagcagtgactgtccgcgggtacgagaccgatgtgcagggacacctcaaccagagcgtgtatctccagtacgcggagcacgcccgctggtcgctgctgcacgcggccgggatcagccagacggagctgacaggcaagggcgtgggtccggtgaccctggagaccaccatccgctacaaacgggagctgcgcgcgggggacgaggtcgaggtgacgtgcggcttcgtctggggcgagggcaagagcttccgcgtcgagcagacgatccggaagacggacggcacggtgtccgccgagctgacggcggtcggcggactgctggacctcaaggagcgcaggctggtcgcggacccacgcgagtacttccgcgcactggccgccgacccgggtttgttcgacctctgaccgtcaatcacgaccccgcgcccgccgtgttgtagagcgggtgcgcggcctcctacccatccagcagttccggccggtgccgggcgtcgtaggccgcgcgcgactgtgcgacggtgacccggtgccgctcggcccagtccgtcagcgacagcagggtcgcgtgcaactcccctgccaccggggtgagttcgtactcgaccttcggcggcaccgtcgaatggacggtgcgcgtcacgagcccgtcccgctccaggttgcgcagggtcagcgtgagcatccgccggctgatgccctcgatgctgcgctccagctcggtgaagcggatcggcccgtgcgcggccgcgacgatgatctgcacgctccacttgccggcgaccctgtcaagaacttcgcggacggggcacgcgtgcgcgttcacgacctgcgccgtaacagcggtgttcccttgggacattcaggtgcctccttatgccggtatccatggtcacccacgatgtactccgttacaagtcgtgcacctaaggtgctttcggagaccacggaggtcagccagccatgtcgttcctgatcgagtcccgcacgcgacagcgacagcgaacgccctcccggtgggcgtccctggtcgtcctgtgcgcgggtacgttgatgacggtcctggacggcaacgtcgtgaccgtggccatgcccgcgatccagggcgacctcggcttttcgggccctgggctcgcctgggtggtgaacgcgtatctgatcccgttcggcggactgctcctgctggtcggccgcctgggcgacctcgtgggcggcaagcggatgttcacggcggggctcgccgtcttcaccgtggcgtccgtgctgtgcggggtcgccaccagccaggccacgctggtcgcggcccgcgccctgcaagggatcggcggagcgatgacctcggccgtcgtcctcggcatgctcgtcgccctcttccccgaaccgcgtgaacaggcccgtgccatcgcggtgttcagcgcggtaggcgcggcgggcggggcgctcggcacattcctgggcggtgcgctgacccaggccctgaactggcactggatcttcctgatcaacctgccgatcggcgtactggcctggctcgccgccctgcggttcctcgccccggagcggggtgccgggctcggcaggggcgccgactacccgggcgcggcgctggtcacgggcgcgctgatgctcacggtgtacgcgatcgtcggcgccggcgaccgcgggctcgccggcacgctggtcctcgcggcggtctcactcgccctcttctccgcgttcaccgtccgccaggcccgagcccctcgccccttgctccgtctgcgcctgttccgctcgcgcgtgctgaccggcgcgaacgccgtgcaggtcctgatgatcggggggatgttcggcttccagtacatcggcgcgctctatctccaacgcgtccttggatacggtgagttgctcaccggaacggctttcctgccggcgccgatcgcgatcggggtgctgatgctgggcctgtcggcgcggacgatcgcccgcttcggcccgtaccgtgtgctgctctcgggtctcgtgctcatctccgccggaatggccctgctgagccgtgcgccggtcgacggcacctacctcgccgacgtcctgccaccgctgcttctcctggccgccggtttcgctgctgccatgcccgccgtgacggggctcgcgatgtcgggcgcccgtgcggaggacgccggactcgcctccgggctcttcaacaccacacaggtggtgggcggttcgctgggtctcgcggtgctgacgaccctggcggcgagccgcaccgaccatctgcggcacgggggcgccgacctcgtggcggccaccgcgtccggctaccggctggcgttcatggtggcgacgggcatcgccgtggcggcgctggtgctggcggcgggggtgctgcgaacggagcgtgccacctcggggcagcccccggcgaacacccccaggtgatccgcacccacgcgtcacagcacgtacgccgccggccccgctcccccatctggccggaacgtgcgctcagaccgcggcccagcgggtatccctgcacacggcgatccccgcacacggcgtcaccgcacccgcacacgatcccttccatgcccacggacccgcccaccacccccaccgcggaacgagggagaccccatgccgctggcgcgccgcgtcctcctgaccgctctcgccgccgggtccgcgggcgccgccgtcgcctgtgacccggcctcggccgacggagcgcccgcggcgggctcggccgcgacggccgcccgccggctcctcccccgtcactggcggcagctgacgttccgcacggcgggcggacgcgacacgttccaggtgtccggccgtacgggccgcgtcaccgtcacgggcggcacaccggcgacccagctcacggggctgaactggtacttgaggaacatcgcggacgccgacatcaactgggcgggcaggcagctccgcctgccccgcgcactgccgggcctcgccggcacagtgacccggcgcgcgaacgtcccgcaccgcttcgccctcaacgacacgaacgacggctacacgggcccgtaccacgactggacgtactgggagcgtgagctcgacgtactggccctgcacggctacaacgaagtgctcgtccaaacgggcgcggacgcgctccaccaccgggtgttccaggagttcgggtacaccgacgaggagctgcggaagtggattccggggccggcccatcagccctggtggctgctgcagaacctctccgccttccccgaccccgtctcacaacagctcctcgacgcccgggccgcgctcggccggcgcatcgcgaaccggctgcgggagctgggcatgacaccggtgttccccggctacttcggcacggttccgccgggcttcgccgaccgcaacgcgggtgcgcacaccgtcccgcagggcacctggatgggcttcgccaggcccgactggctggacccgcgcaccgagcacttcacacgggtggccgcggccttctaccggatccaggacgagatgttcggcggcgcctcgacccgctacaagatggacctgctgcacgagggcggcagccccggtgacgtgcccgtcggcgacgcggcgaagggcgtcgagagggcgttgcgggccgcgcacccgggcgccgtatgggtgatcctgggctggcagcacaacccgcccagggcgatcgtcgacgccgtggacaaggaccggatgctcgtcgtggacggcctctgtgaccgcttcccgaaggtcaccgaccgcgaggcggactggcacggcaccccgtacgccttcggctcgatctggaacttcggcggccatacgaccctgggcgcgaacactcccgactgggcttcgctgtacgagcggtggcgcaccaggccgggcagcaccctgcgcggtgtcgctctgctcccggaggccgcggacaacaatccggccgccttcgccctgttttccgaactcgcctggcgcgagggcgacttggacctgcgcgcatggttcgcgcggtgggcgcgctcgcgctacgggggacgcgatccacatgcggaggccgcctgggacatcctgcgccggaccgcgtacggcaccacgcgcgccgactcgtggagcgagggcgcggacgggctgttcggggcgcgcccctccctcgcggcgacgaaggcggcttcctggtcgccgaagcgcctccgttaccggcccgaggagttcgaaccggcgcttggcgagctcctgaaggtgcggccggggctgcgcggctcgtcggcgtaccgccgcgacctgctcgacgtggcccgccaggcactctccaaccgcagccgggtactcctcccgcagatcaggacggcgtacgaggccaaggacaccgcccgcttcgaccggctgaccggcgtctggctggccctgatggacctgctggaggcactcctggccaccgactcccgtcatctgctgggccgttgggtggccgacgcgcgggcgtggggtgcgagcgcggcggagcgggaccggctcgcgtacgacgccctctcgctgctgaccgtgtggggcacccgcgcgggtgcggacgccgggctgcgcgactacgccaaccgcgagtgggcgggactggtcggcgggctgtaccggctgcgctggtcgacgtacttcgcggagctgcggtcggcgtcgcgggagggacgcacgccgaagaagaccgactggttcgccctggaagatcgctggacccggaatcccgggggcctggcgacgcggcccacgggtgacacgtaccaggccgccgtccgggtgcacgaacggctgaccgccgagcgatagccggggcggccgggggcggcacgggaaccgactcagctttcttgacgggtatacgtcaccctcgaactctggtaggaaactttcctaacagtacgcggaacgacgaactccccctcttggaggtaccgtgcactccccccacatacgcacctcacgccgcaccctgctcgccctgatcggagcctcactggtggcaggcccactcgtcgcgaaccagtccgcgaccgccgcacccgtcggcctggacgacccggcgaagaaagagatcgccatgaagctcgtgtccagcgcggagaactcctcgctggactggaaggcccagtacaagtacatcgaggacatcggcgacggccgcggctacaccgccgggatcatcggcttctgctccggcaccggcgacatgctcgacctcgtcgagctctacacccagcgcaagccggggaacgtcctggccacgtatctgcccgccctgcgcaacgtcaacggcggcgactcgcaccagggcctggacccgggcttccccggcgactggcgccgcgcggcccaggactcggcgttccagcaggcccagaacgacgaacgcgaccgcgtctacttcgacccggccgtccggcaggggaaggcggacggtatcggcgtactcggacagttcacgtactacgacgccatcgtcatgcacggggacggcggtgacagcaccagcttcagcagcatccgcgggcgcgccctggccaaggccgagccgccggcgcagggcggcaacgaggtgacgtacctgaacgccttcctcgacgcccgggtctgggcgatgcggcaggaggaggcccactcggacaccagccgggtcgacaccgcccagcgggtcttcctgacgaagggcaacctgaacctggatccgccactggactggaaggtgtacggggacagctaccacatcggctgacccccgcgcgaggccgcggccgaggcgcacggccgggacgccgcggctccgtgccggacacggagccgcgcgcgagcccggacacgcaaggcgcctgcgagccgggtcagtgtgccgtcaccgcggaaggccccgcggccggggagccggccccgccccgctgcccggcgatctcctcgcccggctccatcggcgccgtcacctcgtcgtccccctggcgcctgcccagatggttgaagaggaggttcagcaccacggccgccacgcacccggtcgagatccccgagtccaggacgatcttcgccgtctgcgggaacgcgtggtagaactccggcgcggtgatcgggatgatgccgaccgccagtgacaccgccacgatcaggacgttgttgtccttctccaggccggcccggaccagggtctggatgccgctggccgcgaccgagccgaacaggacgacgcccgcgccgccgaggacgggccggggcacgaccgcgatcagcgaggcggccacgggacacaggcccatcaggaccaggaagccgccgccggtggcgacgacgtaccggctgcggatcctcgtcatcgcgaccaggccgatgttctgcgcgaaggcgctgcacatgaacccgttgaagagggggctgagggccgagccgagggtgtcggcgcgcagaccggcggcgatggtccgctcgtcggcggggcgtccgacgatctcccccagcgccagcatgtccgccgtcgactcggtcatcgagaccaccatgaccacgctgagggagaggatcgcggcgagctggaaccgcggtgcgccgaagtggaacggcgtcgggaagccgatcaggtccgctccggccaccgggccgaagtccgtgacgccgaggggtatcgcgagcagcgtgccgatgaccaggccgagcaggacggcgatctgcttgacgaagccgtgggtgaagcggcgaaggagcagcacgatcacgagagtcgcggcggcgagccccaggtaggtcgtcgaaccgtaggagtccgccgtggggtcggggccctgggcccagccgaaggcgacgggcagcagggacacgccgatgagggtgatcacggtgccggtgacgaccggcgggaagaagcggacggccttgctgaagaagggggccgcgacgaagccgagggcgccggcgacgatcaccgcgccgaagatgatcgggagggcgtcggacctgtccttggtggaggcgacgatcgcggtcatgggggcgacgccggcgaaggtgacgccgttgacgaacggaagccgggcaccgatcttccagaagccgagggtctggaggaaggtggcgaggcccgcggtgaacaggcaggcgccggtgaggaaggtcagctcggtgccggagaggcccgcggccgcgccgacgatcaggggtggggcgacgacgccggcgtacatggcggccacgtgctggaggccgctggtcgtcatcttcagaagcgggagcttctcgtcaactggatgccggggctggtcggttgggactgcatcggtgctgggcgatggctgggcggccacggcggctcctccggtcgggtgcacgtcgtcgtcgacgtgggtttcagggaggtgatgcgcggtcgtgcgggaccgggacggacaccgttccggggcgcgcacagccatgcgcgccccggacgcggccgccatgaaccccgctcgggtccacggctaccggccgagggccgtccccctcggccggagatctccggttgtcaggcctgcgcggcgatccgcgccagccgctgcgcctcttcccgcgtggagcgggcgacggcgtcctcgtcgacgtgcagcagccggctgttctcgacgaccggctcgccgcccacgagggagagcgtgaccggagccgcggcgccgaagaccagggcggtcaccgggtcggcgatcgaggcgtgggcgagcgtgtcgagcttccacagcaccaggtcggccagcttgcccgtctccagggagccgatctcggctgcccggcccaggacttgggcgcctccgtaggtgccgaggcgcagtgcctgacgggcgttcagggcggcttcgcggtgggcgccgagacggttgatgaggagggcgttgcgcaactcggtgtgcagctcgccggattcgttggaggccgtgccgtcgacgccgaggccgacggggacgcccgccgccagcatgtcggggacccgggcgatcccggccgcgaggcgggcgttggacgacgggcagtgggcgacaccggtcttcgtacgggcgaaggcggcgatgtcggagtcgttcatgtggacgcagtgcgccatccacacgtcctcgccgagccagccggtggactcgaagtagtcggtcgggcccatgccgaacagttccttgcagaactgctcctcctcgacggtctccgaaccgtgggtgtgcagccttactcccttgcggcgcgccaactcggcaccttgcgtgaggagttcggtggatacggagaacggggagcagggcgcgacggcgatctgggtcatcgcgtcgaaggacgcgtcgtggtgctcgtcgatggtcgcctcggtggcggccagcgccccttcgagggtctcgacggcgaagtccggcggcagaccgccgtccttctcactgcggtccatggagccgcgggcgagggtgaagcggacacccgtctcccgggcggcgcggatgatcgcgccggacaggtcgccggagcccttcgggtacacgtagtggtggtccatggcggtggtgacaccgccgcgggccatcatggcgagggagccctgcgcggccgagtgcaccatccgctcgtcgatgcgcgcccaggtcgggtagagcgcgacgagccagttgaagaggttgtggtccgtggccaggccccgggtgatccactggtagaagtggtggtgcgtgttgaccaggccgggggtcacgaggtggccggtggcgtcgatacggcgtacgacgttctccaggtcctcgggggccttgcccgcgccgagcgactcgatgcggccgcctgcgacgacgatgtgtccggaggcgtactcggtgtcgtccgcgtcgacggtcgcgatcgcacagttctcgatgacgatgcgccgggctgctgccatggttcgtccttttccctctgtgaacagggcacggcaggaccctaggagttttgagtgccgcggccgggaggccacgggtgccgaaggaaggtgttttcgggtgcccccggccggccgggggcaccccgggtacgtcagaggttggtgaggtccaccgggatcttcgcctcgcagccgtcccgcaggacggtcgcctcgatcaggccgtagggccggtcggcggcgaagtacacctcattgtcgttcttgagcccgaacggctccaggtccaccaggaagtggtgcttgttcggaagcgagaagcggacctcgtcgatctcgctgcggtggttgatgatccgcgaacccatctggtacagggtctgctggagggagagggagtacgtctcggcgaaggcctggagcatgtgcttcctggtctgctcgtaggacttctcccagtggggcatcttccgctcgtcgtcagaccagttgaagcgccagcgggcagcgacctgggtggcgaggatacggtcgtacgcctcggggagcgtcgtgtacttgtccttgacgtagccccagaactcggagttggtcgagttcatcacgacgaggtccttgaggccggagatgacctcccaggacgagccgtcgtaggtgatctgggtgacgcgggtctcctggcccttgcggacgaaggagtgcttgacctcgtcggcgccgatgaacctggagttggcgtcggaggcctcgatccgctcccaggtgtactcctcgatgcggatacgcgcggtcttgatcggctcctggctcgtcacgaagtgccgggcgaggtggatgccgaactgctcggcggactcgatgccgtgctccttggcgaacgcgtacaccgtgttcttggtggtgtcggtcggcaggacgttggcgttcgagccggagtagtggacctcgtccatgtcgccggagagcgcgacggagacgttcaggtccttgatgtggtgggtggcgccgtcccgcgtgatcttcacgactcggttctcggccttgccgtactggttctggcccagcatcacagggcggccggggcgggaatcgtctgtcatcttctgctagctccctcggtaaacggagtagccgaacgggttgagcagcagcggtacgtggtagtgctcgccgggcttcacggcgaaggtgatcgccacctcggggaagaacgcaccgctgtcccgattcgcgggggcgtcctgctgcgcatcggcttgcttcttctcgaagtacggttcgacggcgaagtcgagccgtacgtgggtggtcccggccggcagggccgggaggtccttgcaccgcccgtcggcgtcggtcgcggagccgccgagcgcctgccagtctcccccttgcccgtaggaggcggagcgccccgagcgggcggcgagctggacggcgacgcccgcggcggggcggccgatgctggtgtccaggatgtgcgtggacaccgaggcggtggtgctggtgctcatgcgtgtgcgtcctcttcgacgagtcgggccaggcggatgcggttgatcttgcccagctcggtgcggacgatctcccgctcccgctccggcgcgttgccgatccgctccctgaccgcgtcgcgcatctgctcgccggtgcggccggtcgcgcagatcaggaagacatgaccgaacttctcctggtacgccaggttcagttcgagcatgtccgccttgagttcctcggaggcgccggccatgccgcgctgctcccgggccgaggtcgggtcgccgggcttggggcggccgatcggcgggtgcccggccatcgcctgcgccaggtccgcggcggtcagttcggccatcgcggcgtcactcgcggtgtagaggtcgtcggcggtggcgtacgggcgggcggcgatcagccgcctcgcccacgtcgtggaggcgcacgcctcgtggagggcggcgagcgccgcgtgctcccccaggtcgttgaaccgggcgaggcccggcggcgtggaagtcgaagtcacgggagcctccgtggccttgtactgaacgggctgccgccagctaacgccctccgcgacacgacgtcaacagtttgttgaaaattctgggtaacagaggcgccgtccggatgccgggcggcgactcgccacccggccgggcagcacatccccggtcagacccgttcgcccgggctcgtgccagccagggcccttccggtcaggcctctttctcgcgattgaggtagttgtagacggtgaagcgactgacgcccagggcgctcgccacggtctcgacgccgtgccgcaccgagaaggcgccgcgcgcttcgagaatccgcacgacctcctgcttggacttgcggtccaggtcggccagcggtttgcccttcttgcgctccatggcggccaggatgtggtcgagggagtcggccagctgcggcagacgtacggcgaccacgtcgacgccctcccaggagagcacgacgtcgtcgacgccggcctcgtcgggcggaagcatctcgccacccatggcgtcgaccagcggcttcacggccgcgatgaacggctcgtccccgttgccggtcacctatcaccctccccgatcacgttgacctggagcgacacacgggtggcacccgcctccagggccttgcgcagcagggcgtccacggcggtgagcaccgcgtcggcgccaccctccgccgtgttgccgaacgggccgacgtccaccgcgtccagctcggccgcctcgaccacctcacgggccaccagcgcgtgcgcgggcgcctcgtcgagatcgaagggctcggtcgtgaactccactcgcaatcgcacactgcccccaggacaacgttctgacctgcgacttccaccgcaagcccagctatttcacggcaacggaccgggtgcgtccgccacgaggcgaccctagccgacacggggttccatccggctccgactccgcaagggcgacgaactcgccctccatgagcggcacttcccggcccccggacgcccggacggaacgctgacgcaaacccttccctaacgttgacaacattgttgacgatctgtcgcgccgacgcataggttcgcatccgccggaagcggcccctcgccttccggcacgcccccaccccggaagagagaagacgcgatgaagcgcaggcagatggtgaaggcgctggccggaacagccgccctaccggcggttgtgggcgcggccggcggtgcccgggccgccggctccggggcggcctccacctcgaccggggcggtctccgccgccaccaggacgaagggctcggaccccctggcattcgacccggcgaactacaccaccctcaccacgaccgtcgccacgagcgacggcgacaaggcggtgacgtaccggttcttcaaggcggtcacctatgtcgccgacccggtcgacgtgacgtaccagagcctcaacgtgagcgtcccggtggagatcgacggcaaggcggtcgatgcctcccacgcgccgatcgtcttcagcaacgcggtcggcggctacatgccgtcctccacggccggcaacaccggcatcggacagggggtcaacgcgaagctgtcactcgcgtccggcttcgtcgtggtggacccgggcgcccgcggccggaccctggtcgacaccgccggcgtctactacggcgtcgccccggccgcgatcgtcgacctcaaggcggcgatccgctatctccgccacaacaagggccgcgtcccgggcgacaccgaccgcatcgtcgccaccggcgtcagcgcgggcggcgccctcacctcactgctcggcgcgtccggcgacagcgaccgctacgccccctaccttcaggagctgggcgcggccgacgcgagcgacgccgtcttcgccgccgccccgtactgcccgatcacggacctcgagcacgccgacatggcgtacgagtggaactggggcaccaacccgctccccaccggcgcacaggtcgatcagaccctctccaaggagctccggagcgggttcgccgagtaccaggcgtcgctgaacctccggggcaagaacggcttcggccgcatcaccgcgcgcaactacgacgcgtacatggtcaagacacacctggagccgtcggccaccaggtacctcggcgccctgccggacgcggaccgcgccgcgtacctgaccgccaacccgtggatcacgtggtccggcggcagggcgtccttcggctggggcgacttcctcacccacgtcggcgcccgcaagaagaacgtcccgtccttcgacaccttcaccctggccgcccccgagaacaacctgttcggcgtggccaccaccaaggcacgccacttcacacagtggagcctgcgcaaggccaccggcgacgacggcgcccgcctcgacgcggacctgcccgagaagatcgacctgatgaacccgatgtacttcatcgagcatcagaacccgggccggtcccggcactggttcatccgcgtgggcaccaaggacagcgacacctcgctgaccgtcgtcggcaacctcaccgccggcctggagaacctcggcgacgacgtcgacacgtacatgtactgggacggcgggcacggcgcgaaccaggacgcccccgacttcatcacctggatccgctcggtcagcgggtacgcgaagtagccaccggccttgccactcctgaagcccggcacgcgggaagcgtgccgggcttcggccgtgtgcgccgccgttttccaccggccccctcttgacaagcgtgaacccccgacggcaatcttccattaagcagaaatgaacttccgtaatgcggaattcaaaaagggaactacgaccacggaagggagcgccggaccatatgccgggtcttgaacggggcaccgccgcggagcagcgcttcaacgtcaatctgtcgatcctcttcacggaactcccgctcctggagcgccccgcggccgccgccgcggcgggcttcaccgcggtcgagctgtggtggccctgggtcgactcccccacccccgaccagtccgagctcgacgccctgaagaaggcgatcgaggaggcgggcgtccagctgacgggcctgaacttctacgcgggccggctgccgggcccggaccgcggcgccctgtcgatccccggcgaggagtcggagcggttccgcgccaacatcgacgtggccgccgacttcgcccgctcgctcggctgcacggcgctcaacgccctgtacggcaaccgggtggagggcgtggacccggccgagcaggacgcgctcgccctggagaacctggtcctcgcggcccgggccgccgaccggatcggcgcgatcctgctgatcgagaccctcaaccagccggagtcgccgcgctatccgttggtgagcgccccggccggcatcgggatcgtcgaccaggtcaacgaggcgaccggtctcggcaacgccaggttcctgatggacctgtaccacctgtccatgaacggcgaggacctgccgcgggtgatcgccgcgtacgcggcgaagaccggccatgtgcagatcgccgacaaccccggccgcggcgccccgggcacgggcacgctgccgctgaaggagctgctcgggcaactccgcaaggccgggtacgagggctgggtcggcctggagtacaagccgggcgaccgtccgagcgccgaggccttcgactggctgccggccgaggcccgcgccgcccgctgagcggccaccccgtcaccgcgcgcccgtgcagcgcgcggcaacgcactgtcgtatcgccgtagttagcgcgcggcaacgcactgccgtatcgccgtagtcgtagtcagagaggcaccctcatgagcagcaaccccgcaccttccccccgcccggcccgcccgctggtcgcgtggatcggtctcggcatcatgggctccccgatgtccgagaacctgatcaaggccgggtacgacgtcaccggcttcaccctggagcaggacaagctggaccggctgaccgccgccggcggcaccgcggccggatcgatcgccgaggccgtgcgcgacgccgacgtcgtcatcacgatggtgcccgcctccccgcaggtcgaggccatctcgtacggccccgacggcatcctcgagaacgcgaggtccggcgccctgctgatcgacatgtcgtcgatcaccccgcggacctccgtggacctggccgaggccgcggccgcgaagggcatccgcgtcctggacgccccggtgtccggcggcgaggccggtgcggtcgaggccgtgctgtccatcatggtcggcggcgagcaggccgacttcgacgaggcgaagccggtcttcgaggcgctcggcaggaccatcgtgctgtgcggtccgcacggtgcgggccagaccgtgaaggccgcgaaccagctgatcgtcgccgtgaacatccaggcgtgcgccgaggccgtggtcttcctggagaagtcgggcgtggacctgaaggcggcgctcgacgtcctgggcggcggcctcgccggctccaccgtgctgacgcggaagaaggacaacttcctccaccgtgacttcaagccgggcttccgcatcgatctgcaccacaaggacatgggcatcgtcacggacgccgcccgcgccgtgggcgcggccctgccggtcggcgcggtggtggcccagctggtggccgcgctgcgcgcacagggggacggcgggctggaccactcggccctgctgaggtccgtggagcgcctctcgggcgcgcggctctgagacctccgggcggcgccgccgctgacatctgtcccgtcgcgcccaagcggtggcgccgcccggaaccaacttcaacaaagtgttgacgcctagaaggtcccatacctaggctccacgaagcggaagaaggtttccgctgcccctcgcatggaaggtgcacgatgtcgaagcgcgtgcttacgaccgagtccggcgccccggtcgccgacaaccagaactcagccaccgccggcgtcggtggtccgctcctgctccaggaccagcacctcctggagaagctcgcccggttcaaccgcgagcgcattccggagcgcgtggtgcacgcccgcggctccggcgcgtacggccacttcgaggtgaccgacgacgtcaccggcttcacgtacgccgacttcctgaacacggtcggcaagcgcaccgaggtcttcctgcgattctcgacggtggccgacagcctgggcggcgcggacgcggtccgtgatccgcgcggcttcgcggtcaagttctacacggaggaggggaattacgacctcgtaggcaacaacactcccgtcttcttcatcaaggacccgctcaagttccccgacttcatccactcccagaagcgcgacccgttcacgggcaagcaggagccggacaacgtctgggacttctgggcgcacagccccgaagcgacgcaccaggtgacctggctgatgggcgaccgcggcatcccggcctcgtaccgtcatatgaacggctacggctcgcacacctaccagtggacgaacgccgagggggaggccttcttcgtcaagtaccacttcaagacgaaccagggcatccgcagcctctccgccgaacaggctcaggagatcgcgggcacggatccgaactcccaccagacggacctgctccaggccatcgaacggggtgtgcgcccgtcctggacgctgtacgtgcagatcatgccggcggcggaggcggcggagtaccgcttcaacccgttcgacctcacgaaggtgtggccgcacacggactacccgctccagcgggtgggccgcctggtcctggaccgcaacccggacaacgtgttcgcggaggtggagcaggcggccttctccccgaacaacttcgtgccgggcatcggcccctccccggacaagatgctccagggccgcctgttcgcgtacgcggacgcccaccgttaccgcctcggcgtcaatcacacgcagctcgcggtcaacgccccgagggcgacggtcgtgagcaactacggccgtgacggcctcatggcctcccccgcacagggccgcgccgcgaagaactacgagcccaactcgtacgacggcccggccgagaccggccggccgctgtcggccccgctggcggtgaccggccacacgggcacgcacgaggccccgccgcacaccaaggacgaccacttcttccaggcgggcgagctgtaccgcctgatgtcggccgaggagcggtcccggctggtcgcgaacatcgccggtggcctctcgcaggtctcccgcgacgacgtgatcgagaagaacctcacccatttccacgccgcggacccggagtacgggacgcgtgtggaggaggcggtccgcgccctgcgcgaggactgaatccccggacggcgcccgggtcccgacaggaggtcggaccccgggcgcaccgcccgcgacggtcgagcgacccggaagaggggtggtcgccccacaccgcgcgggcacggcgaggaccgcggcggtatgcgagccagtgcggtggtgaaggtcccgcggcctccttctcgacctgagggaagaaggccacggctccgtcgcagccgccgcggtcccagccaggcctctgagcgccggatacggacggtcccgtatccggcgctccctggcgtttccgggtgcggatccgtcccggcggcgcgagcctgaaggcatggaacacgcgacgaagtatccgcacatagtggtgcatccaccggccctggacggatcccggcgggtcaccgcgggcgacgcgcccctcgggatcgcctcccatctggacgatgtcatcgagatcctgcgcatggccgacctggaccggatcgaggtcgaggagagcgacctcatcgaatggcagggcggcgggccggacgactggccgggactgtcggagcacgaggacgactgagaagacgactgagaacacgtacgccactcggcgtacgtgtcctacggaaccctcaaatcaagctctgaacaacggtcaaagggcttcaaccaaccccgggcgagggcacatcctcgacacatgaggcccgccggcacgggggcggcgggcctctggtacgggggtacgggggtacgggggatcagcccggggacgcggcccgtgggggcgggccgcgtcgcggggaacggcaggagcaccgggatgtcgagggcggcaaggccggtcggggccggccgcccgcgcacggaggaggggcggctctcccccggatgagccgcccctgtcgagaaacccccgcctgacccccgtgtcaggcctgtgtcccgctatcagaccttcagcgtcctgatcgaggtcggggcgtgcccgggctcggtcgccacctcctcgaactccacgacgtcgctgatgtcgttcgtcctgctcatcgcgatgttggtgacccgctccaggatcgcctcgacgacgaccggcacccggtactccgcggcgagcttcttggcctgctcgaaggcggcgcccagctcgccggggtcggtgacccggatcgccttgcagccgaggccttcgacgaccttgacgtggtcgacgccgtagacgcccagctccggggagttgatgttctcaaactccaggttgacctggaagttgatgtcaagaccgagctgtgcctgccggatcaggcccaggtaggcgttgttcaccaggacgtggacgtacgggatccggtgctgcgcgccgaccgccagctcctcgatcatgaactggaagtcgtagtccccggagagcgccacgacccgtgcctcggggtcggccttggcgacgccgagcgcggccgggacggtccagccgagcggcccggcctggccgcagttgatccagtgccgcggccggtggacgtgcagcagctgggcgccggcgatctgcgagaggccgatggtggagacgtaccgggtctgtgggccgaaggccttgttcatctcctcgtagacgcgctgcggcttgatcgggatgtcgtcgaagtgcgtacggcgctggagggtggccctccgctcctgggtggaggccgcccacccggaccggtcgggcagcccgcccgcggacttcagctcccgtgccacctcgacgaacagttcgagggcggccttcgcgtcggacgcgatgccgtagtccggggcgaagatcctgccgatctgggtgggctcgacgtcgacgtgcacgaacgtccggccggccgtgtagacgtccagtctgccggtgtggcggttggcccagcggttgccgatgcccaggacgaagtcggactccaggaaggtggcgttgccgtagcggtgcgaggtctggaggccgaccagaccggcgttcaactcgtggtcgtcgggcaggacgccccagcccatcagggtcgggacgaccgggacccccgtcaactcggcgaactcgacgaggagttcgcaggcgtcggcgttgatgacgccgccgccggcgacgatcagcgggcgctcggactcgttgagaagggtgatcgccttctcgatctgggcgcgggtggcggcgggcctgtagaccgcgaggggttcgtacgtctccgggtcgaactcgatctcggtgagctggacgtcgatcggcaggtcgatgaggacgggcccgggccggccggagcgcatgagatggaaggcctgctggaagacgccgggaacctgcgcggcctcgaggacggtgacggccattttcgtgaccggcctggcgatcgaggcgatgtcgacggcctggaagtcctccttgtggatcacggcggtcggcgcctggccggtgatgcacagaatcgggatcgagtcgccgatggcggagtagagaccggtgatcatgtcggtgcccgcggggcccgacgtaccgatgcagacgccgatgttgcccgggtgcgcacgggtgtagccctcggccatgtgcgaggcgccctcgacatggcgggcgagggtgtgatcgatcccgccggaggccctgagggccgcgtagaaggggttgatcgccgcgcccgggacaccgaacgcgctgcggacgccctcgcgcttgaggatctcgactgccgcacgggcagcggtcatacgagccattgagtactcctgcttcggctgtcggattcgcgctcccgtcgcgcccagcggagagccatgtttccgtcgacttcttcattgttccgcatagtggaaagtaacttctactatctggaagcaatgtagggggcggggtgaagagcgtcaagagtggggcgaggtcggtgccccctcgggccgatgccggacgcggtgccgggaatccggccctgggcgtcaccgcgtttcgctgccgggagtgccgtgactggaggacgatggaggcgctgtcccgacgtcatccggtggagtgggccatggccgagagcgtgcccgtgcggtgtccggtgtgccggcgcgagcacctgtacgcgacaccgtcctatccgtgcgcctgcggtgcccccgtcgctcccccgctcgaccgtgccgccgccccgagcgccgtcacccaccgcacctgggacgaggattgggtcaccgtccgctgcggggcctgcgggcgcgaggaccagtggccgcaccccgagctgggctgccactgcggggtcgtcctgcggattccggtgtcgggcgggccgggtacgccgggccaggcgccgcggccggcagcggaggccgacgacgctcgcggggcgccccccgtcggagaaccggcggatccacaggagccgacgccgggccaccacacaccaacgccggacgaccacccgccgacgccggaagcgcccggaccggcgcccggcgcaccgtcctcggcgcccggcccccgcggctcaacgccgggcccccgcccgtccgccgcgaagccgggcgcagcggcggcaccgggaggtgcggccggatccatcccgcgcatccccggcacgacgcgccgctcgcgcccccgccccgccgcgctcccccgcgccaccccgtcggcccgccccgccttccagcccgtcaccatccgtaccgcgcgggacgccgtgaccgccgccgcgctgtatctgcgctggctggggtaccaggacgtccggcgcgcggaccagcgcccgccgaacgggatcgggctcgcggcgcgcggaatgctcgcgcaggtggacccgacggtgcggccggcttcgctgcgggacgtggagtgcctgtggctgacggccatgacggagtccgccgggtgcgtctacttctccctcgcgggctacgcggacgacgcccgcgccgtcgccgaccgcctcggcgtccccctcttcgtcctcgacctcacgggcaccccgcagcccgtcaacagcctcgccgacgacctggtggccaccggcgcgtgaggcccggccgggcgccgcgtcagtcgtcccgcccctcccgcgccgcctgctcccgcagttcgatcttgcgcaccttcccggacaccgtcatcgggaaggagtccaggatccgcagccgactggggatcttgtagtgggccagctgcccgtcgcagaaggcccacagctcctccagcgtcggcgggtcggccggatcgcgcgggatgacgcaggccaggacctcctcgccgtaccgctcgtgcggcacgccgaccacctgtacgtcggcgatcttcggatgcccgtacaggaactcctcgatctcgcgcgggtagatgttctccccaccccggatgatcatgtccttgatgcggccgacgatctcgacgtacccgttctcgcgcatcacggcgaggtcgcccgtgtgcatccagcgccccgcgtccacggcctccgcggtcttctcgggttcgtcccagtagccgagcatgacgctgtagccgcgggtgcacagctcgcccgcggtgccgcgcggcaccgtcaccccgcctgccgggtcgacgaccttgacctcgatgtgcgggagcacgcgtccgacggtgccggtgcggtgctccaggtcgtcgtcgcggcgcgtctgcaacgacaccggcgaggtctccgtcatgccgtagcagatggacacctccgccatgtgcatctcggcgaccacccgcttcatcacctccaccgggcagggcgagcccgccatgatgccggtgcgcagcgaggagaggtcgtacgacgcgaagtccgggaggttcaactccgcgatgaacatggtcggcacgccgtacaaggacgtgcagcgctcccgctggaccgccgcaagggtggcggccgggtcgaaggaaggggcagggagcacgatgcacgcgccgtgcgacgtggcgcccaaagctcccatgaccatgccgaagcagtgatagagcggcacgggcaggcacacccggtcctcttcggtgtagccgaccgtacggcccacccagtagccgttgttgaggatgttgtggtgcgagagggtggcccccttggggaagcccgtggtgcccgaggtgtactggatgttgaccgggtcgtcacagctcaagtcggccgcgccggcgatcagccgctcgtacggaaccgaggccgcgcccgccgtcaacgcctcccaggacgggtcgccgatgtagaccgtctcccgcaactcggggcatttctcacgcacttggtcgaccagggcgcggtagtcgctgctcttgtgcgcgagcgaggcgacgagcaccgagatccccgcctgccggaggacgtacgccaactcgtgggcgcgataggcgggattgatgttcaccatgatcgcgccgatgcgggcggtcgcgtactggacgagcacccactcggggcagttgaccgcccagatgccgacccggtcgcccttcagcacgcccttggcgagcagccccagcgccacctcgtcgacggcggcaccgaactcggcgtaggtccagcgccgcccggagggcacgtccacgagggcgtcacggtcgggatacgcggcgatcgcccggtcgaggttcgccccgatggtgtcgccgaggagcggtgtcgtgctcgtcccgtgcgcgtacgacagttcggtcaccggaagtcctcctcgcggtactcctcggccgagcccgccgccgtggcctcgcgcagctcgatccggcggatcttgccggacacggtcttggggagttcaccgaactccagcctgcggatgcgctggtacggcgccaggaccgagcgcgcgtgctcgaagagcaccttcgccgtgtcggggcccggctcgaagcccgccgccaggacgatgtacgccttcggcacggcgagccgcagctcgtccggcgcgggcaccacggccgcctccgccaccgcctcgtgctccagcagcgcgctctccagctcgaacggggagatcttgtagtcggaggccttgaagatctcgtcgcgccggcccacgaacgtgatgtagccgtccgcgtcgcgcgaaccgatgtcaccggtccggtagtagccgcctgccatcgcctcggcggtgcggtcggcgtcaccgtggtagccggtcatcagaccgacgggccgcgccgagagatccagcgcgatctcgccctcgtccactcccggcgcgcccgacacggggtcgagcagttcgacgtggaacccggggctcggccgccccatggagcccgtcttcagcttctgcccggggctgttggagacctggaccgccgtctccgtctgtccgaagccgtcccggatggtgacgccccaggcgcgccgcacctgttcgatgacctctgggttcagcggctcgcccgcggccaccgcctcgcgcggcggggtccgcagctgggtcaggtcggcctggatgagcatgcgccagacggtgggcggggcgcagaaggtggtcaccccggcgcggtccatctccgtcagcagacggcccgcgtcgaagcgcgtgtagttgtgcaggaagaccgtcgcctccgcgttccagggggcgaagaggttcgaccaggcgtgcttggcccagcccggcgaggagatgttcaggtggacgtcgcccggttcgagtccgatccagtacatcgtcgccaagtggccgatcgggtacgacacatgggtgtgctcgaccagcttggggtgggcggtcgtgcccgaggtgaagtacagcatcagcggatcgtccgcatgggtgatgccgtccggctcgaaggccgcgtcggccgcgtacgcctcctcgtacgactgccagccgggccgctcgccgccgacggtgatccgggtgtaacggccgggcacctcgtcgaacttgccggtgtcctcggcgcgcaccacgacgtgccggacgcgtccccgctcgacgcggtcgcgcaggtcggcggggcccagcagcggggtggcggggatgacgacggcgcgcagcttcatcgcggccagcgccgtctcccacagctccgcctggttgccgagcatgaccaggacgcggtcctccgcccggactccccgcgcgcgcagccagttggcgacgcggtcggagcgctcggacagctcggcgaaggacagccgggtggtggcgccgtcctcctcgacgaggtgcagggccgtgcggtcgttgccccgcgcgaggacgtcgaaccagtcgagcgcccagttgaagtgctccgggcggggccagcggaagccctcgtaggccgtggcgtagtcctcgcggtgcgtcagcaggaagtcccgcgcggccctgaatgcgtccgtcgcgctcgtgttcgccgtcatgtgtcctcctcattgccggacagccacctaacatcgtgtaatccgtgatgcaggtctcaccacccccgaacggggggtgcgccgcgatgaaggggcgagcaggtggcagcagacgcagccgaggcggtggaggtgcgcggcgcgttgctacggctgcgccgggcgacggggctcccggtcgccttcggtggactggtcgagcccgggcggccgcagatccgcatcagcgaactgtgcggccacacgacgctcgccctcagctcgctcgcggtggtctccggcagcgggctcggcggcaaggtcgtcgccctctcgcggccgtgcgcggtgacggactactcgacgtcacggcagatcagccacgagtacgacgtggcggtcgccgccgagggactgcggtccgtggtcgcggtgcccgtggtcgtacgccgtcgggtgcgcggtgtgctgtacggcgctctgcgggcggctcagccgctgggcgaccggacgctcacggcggccgtggaggcggcccgggacgtggagcaggcgctggtcgtgcgggacgaggcgcacagcctgatgacggccgcgcgggaacccgagaccgcgtcgggcgcggcctgggagcaggtgcgcgaggcgcacggggcgctgcgggcactggcgccgcgcctcatggacccggcactgcgggccgaactcctcgaggtgtgcgggcagttggccggagcggcgtcggcggagccggccgcggcacacgcgctcgggctggcaccgcgtgaggtggatgtgctggtgtgcgtcgcggcgggggcgacgaacgcggtcgcggccgagcggctggggcttcgcccggagaccgtgaaggggtatctgcggtcggcgatgcgcaagctcggcgcgcacacccggctggaagcggtggtcgcggcgcgccgggcgggggtgctgccgtagcgactgccgacggtgccgacggtcccgacggcctcacggtggcgactgcccggcggctgattccgaccgtcccgccctatttgcacatctccggggtttcgtcgttcattcattcggcacctcagtgaattcccttatgccgtccacctgttatttccctcaccacgccgtccgtccgaatttcaaagattcgttgcctaatattggcccggacacgacacacgaggggagcggtgaccgtgcgacgggacttcaaggagcctgcgagaccccgccccgacctggtcatcggccgggaagaactgttcgcgggggcacgcgagcagctcacccgagggggcagtgtgctggtgcacggcccggccggaataggaaagtcgaccatcctgcgggccctggtcaccgaatacggcgaaacggcgcacaccgtcctgcggtgttcgtccaccgagtccgaatcgcatcttccgtttctggccctggccgacctcctcggtctggtcgaggacgaggtcctcgaccggctgcccgccccgcagcgcaccgctctggagtccgcgctgaccgggcgcggcgagtccaccctccagcgcgacggactcgcgctgcgcctcgcggtgctctccacgctccgtgtcctggccgcccgtggcccggtgctgatcgtcgccgacgacctccagtggctggatccggccagcgccgaactcctcggcttcgccgcgcggcgtctgggcggcatgcccgtccagatgctctgcgcggtccgtaccgacaccgaaccacagggccagcagcacgaccgctatctacgcgcgtccccgccggagacgctcgcggtgcgcgtgaaccccctctcccgcgcccagaccgccgagctcctcggccgtcgcggccacaccgacctgccccgttcgacggtgcgcgacatccaccgcaccagcggcggcaacccgctgttcgcgctggagctgggccgcgcgctggccgagagccccaccccgccgagcccgggcgagccgctgcccgtgccgacctcgctgcgcgcgctcgtcctgaaccggctggacatgctgtcgccccaggcccgccgcaccctgctcgtcgcgagcgccggagcacgcccgacgctcgccctgctgcacgccgcgggccgcgagaacgcggaggcggagacggcgcaggccgccgcgctcgggctgctggtgacggaacgggacgcacccggcgtacggttcgcgcatccgctcgtctccgccgcgctgtacgcggaggcgaccgcgcaggagcgacgggccgcccatgccgcgctgtccacggcggcctccgatcccatcgagcgggcccggcatctcgcgctggccaccaccgggaccgatccccgggtcgccacccggctcggggaggcggcggcggtcgcccgggaccgtggtgcgccgtcggtggcggcggggctcggactgctcgccgcccggcacactccggcggacaccgtgccgggcccggacgagcgacgcctccaggcggccgaggacgcgctgaccgccggggagacggatctcgcccgggacatcgcccgcgaggtgctcgggcgggccggggggcccgcggaccgggtacgggcctggatggtcgtgatcgacgcggcggggcaggccatggccgaggtcgacgccgtcttcccgcaggcgctggccgacgcgggcgacgatccccggcttctcgccctggtgcactaccagctcgcgtggcgggcgctgctggtggagggcgagttcgacaaggcccgcgaggaggccgcccggtccgcggagctggccgcgcgcgccgccgaccggcgcgccgagctcctcgcgctggccttccaggcacagatggagaccctgatggggcacccggacgccccgggcaccatcaagcgggcgctcaaggagccgcaggacccgcgggtggcgtgcgaccacaacggcgccggtgcggcccggttccgctggctgatcatgggcgaccagctcgccgaggcgcgtacgacgatcagcgcgctgctgcgcgaggtgcggcggcgcgggatggtcgagagcgaggtgcacttcctgcgggcgctcgccgaggtcgaactgcgggccgggcactgcgggcgggcgctcgacctcgcccgggagagcctccggctggcgcgggacaccgggatcggcgagggcgccaccgcgatgttcacctcgctcgcggaggccgcgggcggcgaggtgaaccgggcgctgacgctggcccgggaggcggtggggcgcgcggaggaggacggtgacctggtctatctctcgcgcgcgctgggcgccctcgggcacgcccagctcgtggccggggacgcggcgggagcggtgcggtcgctgcggcgggtacgggagctggaggagggactcggggtcaccgaccccgcacgggggcgctggcacggcgacctcgccgaggcgctcgtccgcatcggggaaccggcggaggcgcagggcttcatcgacacgacgcgtacccaggcgttgcggctggggcgcgagagcgtgctcgcggtgctggaccgggcggaggcgctggcgcgggcggcacgcggcgaaatcgacgcggccacacggcagttgacgtccgcgcaggaccggctggccaagctgggctacggcctggaggaggcgcgggccgccttcgccctggccggcctgcgcacgcatcggcccggaccgacctcgtacgacgaggcggcccggctgttccgccgctgccgcgccctgccgtggctgcgccaggtggagaccgcgacggtcaccgggcccgcccagccggccctctccacggcggccctcgacgccctggccgcgacggaacgccaggtggccgcgctggtcatggagggcgcgaccaatcgcgagatcgccgcgcgcctgttcatcagcgtgaagacggtggaggcaacgctgacgagggtctaccggaagctgggcatccggtcccgggtggacatcgtgcgcctggcggcgggcggccgccagggctgactccggggggtgccggggttgattcccggggacggtcggggctgaactccggcggcagccggggctgacttccggggacggtcggggctgaaccccggcggcagccggggctgacttccgggggcagtcggggccgactcccggagacggtcggtgctgattcccgagggcggccgcgccgactccagcggcagcctcgccggctctcgacggcagccatggctgattcccgagggcggccggggccgactccggcggcagccagggccgactcccgggggcagccgggccgactccagcggcaacctcgccggctctcggcgacagccatggccgactcccggagacggccggggctgactcccgggggcagccgggccgactccagcggcaacctcgccggctctcgacggcagccagggccgactcccggagacggccggggccgactccggcggcagccgcccgccgctggggcggacccggtcggccaggggtcacgcacgggcgggcctgcccggcgcggtccggcgcagtccgccgcggtccggcgtagggaccgtctcggccctgcccgcgtcggaggcgctgcgcggctcctcgtccggcgcgcgtcgcggacccggccggtggagcccgccccgcggaaacggcgcctgcggtgtcgactcgtggattccggccaacaaaccgccgctcgccaccccgcaccgcgcagtcccggcccattgcgatccgggcgggtttacgcgcggagaccgagggttttccctgcccaactcccttaggggcttccctcattggaggggcgaccgccggcttctagcgtaagggccgtgccgctcgctcgggcacacggagccggtcccgcggccccgtgaaccaccccccacccgcgcgtccccccaccggcaacactcctgaggagactcatgttcgggctcaatcgcgcaaagaagaccgccgccgtagtcgccgccaccgctgccgccgcggcgacggctctgctggccgccccgggcgccgtcgccgccccccagcccatcgtcggcggctcgacgaccacgacgaccgcgtacccgttcatgatgcagatcacggacgcctcgcagaaccagttctgcggcggcaccctggtctcggccaccaaggtcgtcaccgccgcccactgtatggtcggcgagaccaccagcagcgtccgcgtcgtcggcggcagaacgtacctcaacggcacgaacggcaccgtcagcaaggtcagcaagatctggatcaaccccgactacacggacgccaccaacggcgacgacgtggccgtgctgaccctgtcgacgtcgatgtcgtacaccccggcgtcgtacgtctcgtcgtcccagacgagcatctacgcgaccggcgccaccgcccgcatcataggctggggcaccacctccgagaacggcagctcctccaaccagctgcgcaccgcgaccgtcccgatcgtgtccaacaccagctgcgccagctcctacggttccgacttcgtcgccagtgacatggtctgcgccggatacacctccggcggcgtcgacacctgccagggcgacagcggcggcccgctgctcatcggcggcgtcctggcgggcatcacgtcctggggcgagggctgcgcggaggccggctacccgggcgtctacacccgcctgacgaccttctcgagcctggtgaccgcgcaggtcaactcgtagtcaccgatgaactcctgagcacccctcaggtaaataccagggggcgttgcgggccaccacgagcggcccgcaacgccccctatccatctgtccatcggcctccatcgtgccgatggccctcttcgcgtcggtgatccgcggtccttgacctcatgcccgtacgacggtcccgaaccggatgtcgtacgagttcgtgccgccggccatcaccgcgagcgtccgctcgccctcctgaaccacctcctgccgctgcgccctggtgagcgtgccgaagggctcgatggtgagggcgtcctcgtccagccgccagacgcccgccaggaagccgtcgacgaggagcgtgcagtacgcctggttccccgcccaggtacggcccttgaggtcggcgggcaccacgcgggtgcggtcggcgtgggagaggagcaggttgtcgaactcgggcaggaagcggggcggcgcgggggtgtcggcggccgggcggggcgcgtccgggaggtcgaagagctcgacgccggtctcgtcgcggaaggtgacgagctgcgggcgaaggcgctcgaaggcgtcccgcagccgggtcagacccgcccaggtctgcatgtccttgaccgacgcgggaccgaaggcggccagatagcgcagcacggtggagtcgggcgcgggggcaggcccggcgggacggccgagccagtgctcggcggtggtgagcgcgacctgaccgctcctgccccacagaccgcgcggggtgacctggacgagcgggaggcggcagcgcgcggcgacggcgagggactgcgggtccgcgtccggccactccacgagcagggcctcgcggagctgcttcatcgtgcgcggctcggtctcgacgagctcgcggctgacggcggtgagccggtcgaggtcgacgccggcgagtcccttgcggaagtagttcagttcccggtcgcgggcggcctgcaccagcgggcgcagggtgaggcagtcgtcggcggtgtgggtgtggatggtggagcgcatggtgacgatgcggacgacctcgcggtcggccatgagccgtgacagcgcctcgggggtgaacccgtcgaggcgggcggcgagggcgtagtacggcggcttcacgttctgcgcctggagcccgagcaggtgctcgacggcgtccttcgcggacaggggcgcgcggcgcagcaggagctggcggtcgagggtggcgcggttgagggcgcggggggtgagcacgggagcggccgcggcggcacgggaggccttgggcgccttggacgccctggccttggacgccgtggccgccgtggccgccgtggccgccgtggccgccgtgacatgggatgccgtgacctgggacgccgtggccttctgcgaggtgctcttcgtcatgccgcgcacgctagcggggcttgcggacaccttctgtccgcaactccgaccggataccgcgctcaccgggcacgccgaggccgtttgccccgtatatcctgctccgtgatcaccacagacgtacgttcgagacgggaggcagccgcgatgtccgagcgacgcgcccgcccagcttcgaagaacggcaggaagtccgcctggcgccgggccctgaacccgcccgcgacgccgcccgccgaacctccggcgggcggccccgacgcgccggccccggaaacggcggatgcggccagcgtcgtacaggcgaccctgtaccgcgacggcgtacgcgtctcctcgcccgcctccctcgccgacacgttccgggagctgcgcgacgagccgtccggcatggcctggatcggcctcgcgcgccccacggagtccgaactcctttccctggccgaggagttcgatctgcatccgctcgccgtcgaggacgcgatggaggcacaccagcggccgaaactggagcgctacggcgagacgctcttcgtcgtcctgcgggccgcccgctatctggacgcgccggaggaggtcgacttcggcgaactccatgtcttcgtgggcccggacttcgtgatcacggtccggcacggcgcggcccccgacctgtcggccgtccgccgccgtatggaggagacgccggagctgctgaaactggggccggaggcggtgctgtacgcgatcctggacgcggtggtcgacggctatgtgccggtggtggccggtgtccagaacgacatcgacgagatcgagacggaggtcttccgcggcgacccggccgtctcccgccgcatctacgaactctcccgcgagatggtcgagttccagcgcgccacccgccccctggtcggcatgctgcacagcctgatggcgggcttcgccaagtacggcacggacgaggaactccagcgctacctccgggacgtggccgaccacgtcacccacaccagcgaacgcgtcgacggcttccgccaggcactggcggacatcctgacggtgaacgcgaccctggtcacccagcaacagaacgcggagatgcgggcgttggcggaggcagggttcgagcagaacgaggaaatcaagaagatctcgagctgggcagcgatcctcttcgcccccacgctcgtcggaaccatctatggcatgaacttcgagcacatgcccgagttgggctggagcttcggataccccttcgcgatcggcctgatggggctggtctgcgtcagtttgtacgtgattttcaagcggcggggctggctctgagcccctcgcaccccgctcagttctcccttcgagaatcaccacgccccttcgagacggtcacttgtcggtctggagtaccgccatcatccccgcgtcctcatggttgaggatgtggcagtgcaggaccgtcctgcccggatagtcgaggaaccggatacggatgaccgtgtttccgcgtggcgggacgtcggcggtttcctacaagccgtagttgacctgcggcttgccgttgatacgcatcacctggaagtcgttggtgtggatgtggaacgagtgggactcgtcgctgtcgttcttgatcgtccattcctcgacggtgttgagcctggcccggaagtcgacgcggccgtggtcgaactgcttgtggttgatgtagaagagcgtgccggccttgttctccgtgaagatgaccgtctcgcgtcccgcgacggcctccttcccgaggtcgtccaccggggcgaaggctgtgggcagggccgcgagccgcatcggttcgccctcggtccggaccgtggccagtgtcgcccgggggaactggtttccggccttgccgctggtgtacggcgacgatgtggaactcggtgcccggcagcgtcacttagtagaggatgttggccccgatgttcccgagtcgccacaactgggtctcgccgggcctgatccggatccgtgggttgagctgcccgttgacggtgcgtgtcgtgggtgcaccgatcttgagcttcgtggtcttgatctggtcgcccacgagttggaagtccttgagcgcgacgacgtgttccgtgatcccgcggagcggcgcgggcagatactcgtcgaggccgtcgaccacgatcaggccggccatgccaccggcggtccgggcggcggacaacgtgtgcgggtacgggtgataccagtacgttcccggctccaggctcttggagaaggtgtactcgtaggtgaacgtcttccccggctcgatcttgaggaggacgttgtccgaatccccgtgctgccgcagtgccgcggtcccgtagtacggattccgcccggggtccgtagtacggactccgcccggggatcaaggtcaacaggaagagggcaaggtcacagccatgacctctgctgctcctttgtccgtctgccctaacatccgagcatgacggtcctgcctgacgacgggctttcgctggccgccgagttccctgatgcgacccttgagcagtggcagcgcctcgtggcgggcgtactgcgcaagtcgggcaaggaagtctcggacacggcagccgaggaagctctgtccaccgcgctggaggacggcctcgccagccggcctctgtacacggcgcgcgactccgcgcccgatcccggccttcccggtttcgcccccttcgtccgcggtggccgcgccgaggggaacaccaccggcggctgggacgtacggcagcggcactcggccgccgacggcgacgcggtgctcgcggacctggagaacggcgtcacctcactctggctggtcgccggcgcgggcggaatccctgtgccctcgctcggccgggtcctcgacggcgtctacctcgacctggcgcccgtcgccctcgacgcgggaggtgacaccgagcccgccgcgcgcgagttgctgcggctgtacgcggagcggggtgtcgccaaggaggcggcgcgcggcaatctgggtgcggacccgctgggccacgaggcccgtacgggagacgagccgttcgacttcgcgccggtcgccggcctcgcgcggttgtgtgccgaggagtacccggggctgcgcgcactgaccgtggacgcgttgccctaccacgaggccggtggctccgccgctcaggagctcggctgttcgctggcgaccggcgtcgcctatctgcgggagctgaccgcggccggcctctcggtcgaacacgcctgcgggcagctggagttccggtacgccgccaccgccgaccagttcctgaccatcgccaaactgcgggcggcccgcaggctgtgggcacgggtcgccgaggtgtgcggggcgccgggcgcgggggcgcaggtgcagcatgccgtgacctcgccggtcatgatggcgcgccgcgatccgtgggtgaacatgctgcgtacgacggtcgccaccctggcggccggggtcggtggcgccgacgccgtcacggtgctgcccttcgaccacgccctcggccttcccgacgcgttcgcccggcggatcgcccgcaacacctcgacgatcctggtcgaggagtcgcatctgtcgagggtgatcgatccggcgggcggctcctggtacgtggagcggctcaccgacgaactcgcccactcgggctgggagttcttccaatggatcgagcgggagggcggccaggcgggggccctgcgctcgggccggctcgggcaggacctggcgaacacctgggcggcgcggagcgcgaagctcgccgaacgacgtgagcccgtgaccggggtcagcgagttcccgagtctcgccgagcgccccgtggagcgcgcgcccgcacccgcctctccgtccggcggcctcccccgggtgcggcgcgacgaggcgtacgagacgctgcgcgcccgctccgacgcccacctggcggcgaccgggtcccggccgcggatcttcctggccgccctgggtcccgccgccgcccacaccgcccgtctcgccttcgcctcgaacctgttccaggccggtggcatcgagcccgtcacggagggcacgttcgaggacagcggtgccaccgaggtctgtctctgctccagcgacgcgctgtacgaggagcgggccgcggaggtcgccggggccgtcaaggcggcaggcgccaggcatgtgttcctcgccggccgtcccgggcggtaccccggtgtcgacagccatgtcttcgcgggctgtgacaccgtcgccgtactctccgccaccctcgaccgtatgggagtgtcctgatgggaatccccgacttcgccgggatcgagctgggcacgcccaccgcctccggcggccccgacgagtggcgtacggccctgaagaaggcgaccggcggcgacgacctcctctgggagacccccgagggcatcacggtcaagcctctctacaccgggcaggacgtcgagggcctggacttcctgggcacgtacccgggcatcgccccgtatctgcgcggcccgtacccgacgatgtacgtcaaccagccctggaccatccgccagtacgcgggcttctccaccgccgaggagtccaacgccttctaccggcgcaacctggcggccggccagaagggcctgtccgtcgccttcgacctgcccacccaccgcggctacgacagcgaccacccccgcgtgaccggtgacgtcggcatggcgggcgtggccatcgactcgatctacgacatgcggcagctcttcgacggcatcccgctcgacaagatgaccgtgtcgatgacgatgaacggcgccgtgctgcccgtcctcgcgctctacatcgtggccgccgaggaacagggcgtgccgcccgagaaactggccgggaccatccagaacgacatcctcaaggagttcatggtccgcaacacctacatctatccgccgaagccgtcgatgcggatcatctccgacatcttcgccttcacgtcgcagcggatgccgcggtacaactccatctccatctccgggtaccacatccaggaggcgggcgcgacggccgacctggagctcgcgtacacgctcgccgacggcgtggagtacctgcgggccggccaggaggccggcctggacgtcgacgccttcgcgccccggctctccttcttctgggcgatcggcatgaacttcttcatggagatcgccaagatgcgggccgcgcgcctgctgtgggcgaagctggtcaagcagttcgacccgaagaacgccaagtccctctctctgcgcacccattcgcagacctccggctggtcgctgaccgcgcaggacgtgttcaacaacgtgacgcgtacgtgtgtggaggcgatggcggccacccaaggccacacgcagtccctgcacaccaacgcgctcgacgaggcgctcgcgctgcccaccgacttctcggcgcgcatcgcccgcaacacgcagctgctgatccagcaggagtcgggcacgacccgggtgatcgacccgtggggcggcagcgcgtacgtcgagaagctgacgtacgacctggcgcgccgggcctggcagcacatcgaggaggtcgaggcggcgggcggcatggcgcaggccatcgacgccggtatcccgaagctccgggtggaggaggccgcggcccgcacccaggcgcggatcgactccgggcgccagccggtcatcggcgtgaacaagtaccgcgtcgagaccgacgagaagatcgacgtcctcaaggtcgacaactcctccgtccgcgcccagcagatcgagaagctccggcggctgcgcgcggagcgcgacgaacaggcctgccaggacgcgctgcacgccctgacccgcgccgccgagggcaccggcaacctgctggagctggccgtgaacgccgcccgcgcgaaggccaccgtcggggagatctccgacgccctggagaaggtgtacgggcggcacgcggggcagatccgtacgatctccggtgtgtaccgcaccgaagcaggcgagtctccgtccgtcgagcgcacccgtacgctcgtgggctccttcgaggaggccgagggccgccgtccgcgcatcctggtcgccaagatgggccaggacgggcacgaccgcggccagaaggtgatcgccaccgccttcgccgacctcggcttcgacgtcgacgtcggcccgctcttccagacccccgccgaggtggcccgccaggccgtggaggcggacgtgcacatcgtcggcgtctcctcgctggccgcggggcatctgaccctcgtaccggcgctgcgcgagcagctcgccgaagaggggcgcgaggacatcatgatcgtggtcggcggggtgatcccaccgcaggacgtgccgaccctgctggagatgggcgcggcagccgtcttcccgcccggcacggtcatccccgacgcggcgtacgacctggtgacgcggctggccgccgatctcggacacgacctctgagccgaatgagccccatggcgatcgacctcgacagctatgtgaagggcgtactcgaagggaagcgggcgcagatcgcgcgcgccatcaccctcgtcgagtccacccggcccgatcaccgttccctggcacaggagttgctcaccgagctgctgccgcacagcggccaggcgaaacggatcgggatcagcggtgtgcccggggtgggcaagtcgacgttcatcgacgcgctcggcaccatgctcaccggcctcggccaccgggtcgcggtcctggccgtcgacccgtcgtcgagccggaccggcggttcgatcctcggcgacaagacccggatggagcgtcttgccgtcgaccccgcggccttcgtacgcccctcccccaccgccggcaccctgggcggggtcgccaaggcgacccgcgagtcgatcgtggtgatggaggccgcgggctacgacgtcgtcctggtcgagacggtgggcgtgggacagtcggagaccgcggtcgcgaacatggtcgactccttcctgctgctcaccctcgcccgtaccggtgaccagctgcaaggcatcaagaagggggtgctggagctggccgacgtgatcgccgtcaacaaggcggacgggccgcacgagcgcgacgcccgcgccgcggcacgggagttggcgggcgcactgcgcctgatgcacggcgccaacgccgcctggaccccgcccgtgctcagttgcagcgcgcgcgacgcggtgggcctggacacggtgtgggagcgcctcgaacagcaccgcacgctcctcgactcgaccggccggctcgccgccaagcgccgcgaccagcaggtcgactggacctggaccatggtccgcgacgaactcctcggccgcctgcacgccgatccggccgtacggaccctcgcgccttccctcgaacagcaggtgcgggacggcgcgttgacggccacgctcgccgccgagcgcattctgcgggtgttcggcgacggggtgcggtgaaccgccggagggccgacgtccgctccgggtgacgtcctgccgcctcgccgcgtcgtgcagaggcggcgcgggggtgtgcgggtcattccggtcggtgtgccaccggatacggaacgaacgtggtgctgttctggtcgatccgtagcgggcggccgaggggcggtgcggcgcgctggggacagtcgaggcgttcgcagacgcggcagcccatgccgatggggatggcggcggaagcgttgccgaggtcgaggccgtccgagtagacgagccgggaggcgtggcggatctcgcagcccaggccgatggcgaaggtcttgccgggctcgccccagccgccgcgatggcgggtgatcgcccgcgccgtccacaagtagcgctgcccgtcgggcatttcggcgatctggacgtggatgcggccgggcgcggcgaacgcttcgtagacgttccacagtgggcaggtgccgccggcgcgggagaagtggaagccggtcgcggactgccgtttggacaggttgccggcccggtcgacgcgtacgaaggagaagggcactccgcgcaggcgggggcgctggagggtgctcaggcggtggcagacggtctcgtagccgaggccgtagcggtcggtgaggcgctcgatgtcgtaccgcgcctcctccgccgcggcgtggaacgtgcggtagggcaggatcagcgcggcggcgaagtagttggcgatgccgatacgggccagggcatgcgtgggcgtagcggtcgggaagtcctgggccgcctggtggtccagttcgtcgccgtactccagcagggcgagttgggtcgccatgcgaaacgcccgctgtccggggcggaggcggctggacaggtggagagtccgggacgcgtcgtcgtagtgatgcaggtggtcaccggtctcggcggtcagccgcacgccgtgccggtcggcgagtcgcgccgtcagcgcccgtacgacctcgccgggccggatgccgatctcctcggccagccgctcggccgcgaggtcggtgtcgtgcaggtagttctgccggcggtagaagaagtcccggatctcctcgtgcggcgagcggggtacgtccggctcgccgtcccggccctccgcggcctcggcgagccgctcggacaggagttggttgcggcggcccaggtcgagcaggaccttcgcgacggccggtatccgcgaggcgagctccgtcagatcggaggcggacacccgggtttcggcgatctcgcgcgccagcgcctcccgcagatccgccatcagccgggtcgtgtcgcgctcggagaagaagcccgcgtcgacaccgaaggcttcggtcagcctcagcaggaccggcacggtgagcggccgggagtcgtgctccatctggttcagatagctgggtgagatgcccaggacccgggccagctcggcctggctcatccggcgttcctcgcgcaggcgtcgtagccgcgctcccgcgtaggtcttgcccaccgcactcctccgttgtcccggacggtcgtcagcgtacgcgaagagccatcgcccgcaccctttgcaaacttggcagaacgggccgtgaagattcgcagaaattggcactcgtccacgattgatggcacccagtgccagtgtcagagtttcggtgcggctcgccggacctacggcatccggcgcacagcacgggactcaattcatgccctgacgtcggatatcccggcatccgcgccggaccgcacggcagcattgctcagctccgcccactgccaggacggcgggccgcaccccagagacaggcacacagtgccactccctttcgtcagcggtggggagcttggcagaacggacaaccgaggagacggtgaaggccatggcagaggcgaggacgacggcggccgaggagctcacacgacgctgggccttcgacccccggtggcaggggatcgagcgcacctacggcgccgcggacgtcgtacggctgtccgccagcgtccgtgaggaacacaccctggcccggcgcggtgccgagcggctgtggcggcagctgcacgagctggactacgtccacgcgctcggcgcgctcaccggcgggcaggccgtgcaacaggtgaaggcggggctccaggccatttacctgtccggctggcaggtcgccgccgacgccaaccaggccgggcacacctaccccgaccagagtctgtacccggccaactcggtgccgcaggtggtgcgccggatcaacaacgcgctgctgcgggccgaccagatcgccaccgccgagggcggcgaggacaccaccgactggctcgcgccgatcgtcgccgacgcggaggccgggttcggcggccccctgaacgccttcgagctgaccaaggcgatgatcgccgcgggtgcggccggtatccactacgaggaccagctcgcctcggagaagaagtgcggtcacctcggcggcaaggtgctggtgcccacctcccagcacatccgcaccctcaacgcggcgcggctcgccgccgacatcgccgacgtgcccacggtgatcatcgcccgcaccgacgccctggccgcgaatctgctgaccagcgatgtcgatgagcgcgacgccgagttcgtcaccggcgagcgcaccgcggagggcttctaccgggtacggggcggcatggcgccggtcatcgcccgcggcctcgcctacgccccgtacgccgacctgatctgggtcgagaccggcaccccggacctcgcgcaggcccgcgagttcgccgaggcgatccacgccgagtaccccgaccggatgctcgcctacaactgctcgccgtccttcaactggaaggccgccctggacgacgaccagatcgccaagttccagcgggagctgggcgcgatgggctaccgcttccagttcatcaccctggccggcttccactccctcaaccacggcatgttcgacctcgcccgcggctacgccgagcacggcatgaccgcgtatgtcgacctccaggagcgggagttcgccgcgcaggagcacggcttcaccgccgtcaggcaccagcgcgaggtcggcaccggctacttcgacctggtctccaccgccgtcaacccggcctcctcgaccacggccctggcgggctccacggaggaggagcagttccactagccggccctccggtgccgcgtccaccggcccatgaccgggcgggggccgggcgaccgtcccccgcccggcccgccgcccgcatcgcccggcccgccgcccgcatcgcccgtcctccgccgcttcgcttcccgatcaggagaacctgatgtccaccagcgcactgacacaccgcgtccgggtcctcgcggcaccgggcgaccgccacgacgagatcctgacacccgccgccctggacttcgtcggccgcctcgtcgcggccttcggcgagcggcgcccggagctgctgaaggagcgcaggcggcaggcgatacggctcgcggccggatccgcgctcgacttccccctcgccaccgccggtgtccgggcggacgcctcgtggcgcgtggccgcaccggcccccggcctgaccgaccggcgggtggagatcaccggcccgcccgaccgccgtacggccgtcaacgcgctcaactccaaagcgcgggtgtggatggcggacttcgaggacgccacctcccccacctgggacaacatcatcggcggccagctcacgctgctcgacgccatcgagcggcggatcgacttcaccacaccggagggcaaggagtaccggttgggtgaccggctcgccaccatcatggtccgcccccggggctggcacctgacggaggaacacctggagttcgacggccggcccgtacccgcctccctcgtcgacttcggcctgtacttcttccactgcgcgcagcgccagatcgacgccggacacggaccgtacttctacctgccgaagctggagaacagatacgaagcccgcctgtggaacgacgtcttcgtcctcgcccaggagctgctcggcatccccccggggaccatccgggcgaccgtgctcatcgagacgatcaccgccgccgtggagatggaggagatcctctacgagctgcgcgaacacagcgccggcctcaacgcgggacgctgggactatctcttcagcttgatcaagaccttcgggcaccgcaccgacttcctgctgcccgaccgggccacggtgaccatgaccgcacccttcctgcgcgcctacaccgaactgctggtgcgcacttgccaccggcgcggcgcccacgccatcggcggcatgtccgcgcaggtgcccggcagggatccggccgcgggcgaggcggccctggcgaaggtccggctggacaaggagcgcgaggcggaggacggcttcgacggctcctgggtggcccaccccggcctggtgcccatgtgccgcgaggtcttcgacggtgtcctcggcgagcggccgcaccagatcgagcgcacccgggacgacgtggaggtgaccgccgcggacctgctgtcggtgcggcgcatcagcggaccgccctcgccggaaggggtccgtaccaacatcgcggtctcgctgcgctacttcgacgcctggctgcgcgggcggggggccgtcgccctgtacggcctgatggaggacgcggcgaccgcggagatcgcccgcgtgcagatctggcagtggctgcggcaccgggtcgtcgaccgggataccgtggtgcggctgctcgacgacgaactcgccgccctgggcgcggagtacccctgggcggccctcgacgaggtgcgtgcccttttcgaacgaacggcgctggccgccgagttgccgctgttcttcaccccggacgcctacacccgtcacctcgtccggcacgcggaggcgcggtcatgagccgaggcatccgacgcgtcggagtggtcggcggcgggcagatgggcgccggcatcgccgaggtgtgcgcccgagccggactggacacgatcgtgtgcgaggtggacgccgaggccgcccgagccgcacgggaacgcgtggaggcctcgctggatcgtgccgtccggcacggaaagctggaccgggccgccgcgcaggacgccctcgcccgtacgaccttcacccgcagcctcgaagacctcgccgaccggcagctcgtggtcgaggccgttgtcgagaacgcggacgccaagaccgaggtcttcgccgcactggacaagatcgtcgaggatcccgaggcggtcctggccacgaacacctcctccctcccggtcacgcgcctgggcatgacgacacgacgcgccgaccgggtcatcggcctgcacttcttcaacccggtaccggtcctgcccctggtggaggtcgtcgcctccctccacacctccgcgcggaccgtcgacgccgtcacggacttcgccacccggtcgctgggcaagaccgtcatccgctcgcaggaccgggccggcttcgtcgtcaacgccctgctcatcccctacctcctgtcggcgatccgcatgacggagtccggcttcgcctccgtcgccgacgtcgacgccggcatggaacgcggctgcgcccatcccatgggaccgctgaagctggccgacctgatcgggctggacaccgtcgcctcgatcgcggagtcgctgtacgacgagttcaaggaaccgctctacgcatcgccgccgctgctccagcggatggtggaggcggggctgctcggccgcaagacgggccgtgggttccacgtgtacgaccagggctgaggggcccggtccgccgccggttgagggaccggcggcagctgaggagccagggcgggcgacgccacgggaggacggcgccgcccgccctgttcgcctgtccggcgtctcgtcgcaccgtccgggatgtgggcatcgtctaggctgggtggtgcagctggttcgccccgtccgccaggcgggaggcgtcgtaagagggaacccggcgggaatccgggactgccccgcagcggtgagtgggaacgaacgctgtcatacgcactgggcccaaaaggcccgggaagcgacggccagtaggtgtcctccgtacggagggcgtgctcgcgagtccgaagacctgcccgctgcccgtgcgcgaccgttcgcgcgcggacatcccggtgacctcgtgggcgggtcggcgtgcatacctgacggacgaccgcgccttgccgcgcgggtcggctccgtccggtccgtcaccccttcgcgctcgcgtcccgtcccgggatctcagggacacatctcgcgaaggagagatccgtgacagcgaagtccgcagccgcggcggcacgggccaccgtgtacggctacccccgccagggccggggccgggaactgaagaaggcgatcgaggggtactggaagggccgcctcgacgccgacgccctccggaccaccgccaccggcctgcgccgggacacctggcagcagctggccgaggccggcatccacgaagtaccgaccggcgacttctcgtactacgaccacgtcctggacaccagcgtcatggtcggcgcgatccccgcacgccaccgcgccgcggtcgaggccgacgcgctcgacggctacttcgcgatggcgcgcggtacgcaggacgtggcgccgctggagatgaccaagtggttcgacaccaactaccactatctggtgccggagttgggtccggacaccgtcttcagcaccgactccgccaagcaggtcgccgagctcggcgaagcgctcgccctcggcctcaccgcccgcccggtcctcgtcggcccggtcacctatctcctgctcgccaagcccgcgcccggcgtggccgcggacttcgacccgctgaccctcctcgaccggctgctgcccgtgtacgccgaggtcctcgccgacctgcgggcggccggcgccgagtgggtgcagctcgacgagccggccctcgtccaggaccgcacgcccgccgaactgaacgccgccgagcgcgcctaccgcgtcctgggagggctcaccgaccgcccgaagctgctggtcgcctcctacttcgaccggctcggcgacgccctgcccgtcctcgccgaggcacccgtcgagggactcgcgctcgacttcgccgaaggggccgccgcgaacctggacgcgctcgccgccgtgggcggtctgcccggcaagcgcctggtcgccggtgtcgtcgacgggcgcaacatctgggtcaacgacctggagaagtccctcgccctgctgggcaccttgctggggctcgccgaccgggtcgacgtggccgcctcctgttcgctgctccacgtcccgctcgacgccgccgccgaacgcgacatcgcaccgcaggtcctgcgctggctcgccttcgcccgccagaagaccgccgagatcgtcaccctcgccaaggggctcggccacggcaccgacgccatcgccgcgcagctcgccgccaacagggccgacctcgtctcccgcgccgactcggcgctgacccgcgacccggcggtacggtcccgcaccgccgccaccaccgatgccgacgcccgccgctcggggccctaccccgagcgggccgccgcccagcgcgcccgcctcggtctgcccctgctgccgaccaccaccatcggctccttcccccagaccgccgaactgcgcaccgcgcgggccgacttgcgggccgggcggatcgacagcgccgggtacgaggagcgcatcagggccgagatcggcgaggtgatctccttccaggagaaggcgggtctcgatgtcctcgtgcacggcgaggccgaacgcaacgacatggtccagtacttcgccgaacggctcaccggctacctcaccacgcagcacggctgggtgcagtcgtacggcacccggtatgtgcgcccgccggtcctcgccggcgacatctcccgcccggagccgatgacggtgccctggacgacgtacgcgcagtccctcaccgaccgcccggtcaagggcatgctgaccggcccggtcaccatgctcgcctggtccttcgtccgcgacgaccagccgctcggcgagaccgcccgccaggtcgccctcgccctgcgcgacgaggtgggcgaccttgaggcggcgggcacttcggtcatccaggtggacgagcccgccctgcgcgaaaccctgccactgcgcgccgcggaccgtcccgcctacctggcctgggccaccgaggcgttccggctcaccaccggcggcgttcgcccggacacccagatccacacgcacatgtgctacgccgagttcggcgacatcgtccaggcgatcgacgacctcgacgccgacgtcatcagcctggaggccgcccgctcgcacatgcaggtcgcccgggaactggccgagcacgcctacccgagggaggcggggcccggcgtgtacgacatccactcaccgcgtgtgccgggcgtggacgagaccgcggccctgctgcgcaagggacttgaggccatccccgccgaacgcctgtgggtcaaccccgactgcggtctgaagacccgcggttggcccgagacccgcgcgtcgctggagaacctggtcgccgcggcccggacggtgcgcgcggagcacgccggctcctgacgcctgcgtacggccgagagggcgccgcccgggcaccctctcggccgtgccgccgtgatgtgatgccgtacgaagcgcgtgtgcgcgtcgccggcacgaggaagacaggagcgaaggcgtgaccagtcgcgtcaccttgatctcacccgcgatgaaccggtccctgcgggaggcccggttcgacgacggctgtcggctcgacgcgagcggcgcggcacacgccgagtccgccgccggcacgctgcccgcagccgaccgggtgtgggtctcccccacggcgcgctgtcgggaaacggcgtcggccctcggcctcaccgccatggaggcccccgagctgggaggtctggacgtgggccggtggcggggccggaccctcgacgacgtcagcggcggagaaccgcaggcggtcgccctttggctgacggacccggccgcggcaccgcacggcggggaatcggtgcgtgccctgtgcgcgcgcgtcgccgggtggctgctcacctgcgaagagatcgcgggcaggacccttgccgtagtggagccggagatcgtacgggccgtggtgatcacggtcctcgaatcgccggaggcggccttctggcggctcgacgttccgcccctgacggcgacggacatcagcggacgctccgggcgctggaatctgcgcatgggacggccgcttgacgtgcagggaaacggagttggaactgcaactgcaactgcaactggagctgaaactggcgccggacactgacgcgaagccgatgcggccggggctggagccggggctggggctggggctgggggctggggctggggctggggctggggctggggctgggggctggggcccggccgttaccggcgcggcggcgaaggcgaaggcgaccgcttgtcacccgggtcccgcccgcctgtcccgctccgatggcgccggagcagtgccgtgagcgcgcagcacaagcagtccgaggccgttcccgcggccccgggtccccgcgcccccacccggtccgtcgcgtccgccccctgcggctcccgctggcatggcgcggcgtcgcccggcacgccctgcgggccgggacagccgtccgtgtgccgaccgatcagtgcctcaaggtccgtgagcagttcctcgctctgcttcacccgctgggacaacgcccttacccgggcgctctgaccgccgatctgccgtctgctgacgatcagccgctcgtactcctccagggtcagcgcgaccgcctcgcgaccgccgagcgtgatgtgccgcggttgtagttgtctggccactggggtcctccgccctgtccctcgctgtcgccgtcaccacgcgcgcgtagtcggggagtcatgtgagtcgtccggctgttcgcgagccgtcggtgtcggaagaacgcgagagggcccccggatggttccggtgggccctctgggcgtcgacgctgtccgaaattaccggggcgatgtccttactggggtacgggagtggcctgcgcgggcgcgaccggttccgtgcgcggagcgagcagccgttgcgccaactccccgaagatcaggccgaatccggtccacagggtgagctggatggcgagggcggaggtccggaaccgccacagcagggtggccgggaaatccttcgggacctcgttgatgaccggcaggaacgcgtacgcgagaccgatcgcgaggccgaagaaggcgaccgccgcgacggtggcgtaccacgtaccccacctgggtgcgagccgcttgccgaggatcaccgcggcgaccgcgaggagcacgctgagcaccatcatcaggaagtacagggtcgtgcgcttgccgatcgtgtcggggtcgccgaccgacggcgggttggccgggtacttcaggaacggcacgacgtacacggcgagcagggccgtggccgagagcagcagggccgtggcacgcggcgtgaagcggccgacgcggccgagggcgaagcagtaggcgagggcggctatgccgccgaaggcgacgccgtagaccaggaccccggtggcgaggccgccggtggactggaggccgcggctgaccagttcgacctcgtgctcgtgcgccggggcatgggcctcttcgaatccgatggcgtcgtcgacgccgggttcgcccaggaagtaggcgacgaggagggcgagcacgccggcccccaggccggcgagcatgccccgcacgagaaggtttctgacagttgtggagttcatgggtgtgcggcgtccctcgtcagtggcaggggaagccgaggaggtggcgggcgtcgtgcacccactcgtggacgtccgcgccgttgaccacggaggtggctccctgctcggcgccgacgaagtacagcaggacgagcatcagaatgccgaagaagaccgcccaagggacgatcgcgccgatcggcagcttggcgggaagagcgggagtggtggctgtcggctgggcgacggtctgcgccatggcaggacctcctcgggagttcgcgtcccatctcggtggtgcacaggacgacagccgcgggtctgacttgcgaggcgcttcgcccatcggggcggctcgtctcgttcacagtggcgcgaccgtgccggatttccaccggcttccgctatgccgtcgtcgttatcgcaccgaccgtaccgcgtgccgggtccctggccaagaccgggccgcctgccgtgatcttcgtgcggcacaggacggccggccggagtgacgcaggggtcagcggtgctgggcgcgccggcggtgacagcggcgggcggagtgcgccggcctcggctcccgcgccggccccggcggaccgccgcccgccgatgtcgtagacgctgtagtcgcgcggcgggtcgatcatgccgaaccacgcctcgtagatctgcgagtgcggcccgtcgacgtacggatcggcggggagttcggtgtcccggagcccggcgcgctcgatgacgttccgggtgatgtaccgctcggctgtagtgccggtcacctgttcaaggagttcgccgaggagcaggtagttggtgttggagtacacccccggagtgccgcccggggcgccgacggcaggtgcggtgacccccatctcgatcagttcggtggggtgaaaccgcgtgagccggttgtcgtccaggctctggggcccggtgtccgcgagggcggggaacgccctgagggaggggtaggcataaggaaggtactcggcgaggccgctgctgtggttgatcaacatccggaccgtgatcgcgtcaccgcgttctccgggaaccagcctcggaaggtaccggccgatcggagtgtcaagaccgatcaggtcaccgacgaggagtgcaacgccccgcgcagcagcacccgctgacgcccaccgacagcaccaacaggtcctcagcccgtacgggtagggcagtccccgccctcagggtgtagccagctccaccttcgatttgggggtgcactgtctcgtgacggcgagcgggcgacggcatcgttgaacccagccgatccaagaggttcaccgctcccgccgcccggaaggacaccgccatgaagtcgctgctctcgtcgaagccggagacggcatacgagacgcggcacatggagcggacggcgggcggcgtgcacgacaccgccgcacgcaggaccccggccgctcccggcccgctcgcttccttcgcccggttcgtcctgtgcggcggcggagtcggggtcgtctccagcaccgccgtggccctgctggccgcactgatgccctgggcggtggcgaacgcgctgatcaccatggcctccaccgtcctctgcacggagctgcacgcacgcttcaccttcggggccgggcagcgtgccggatggcgtcagcactggcagtccgccgggtcggccacggccgcctacgcggtgacctgcgccgccatgctcgtgctgcgcatggtgcagccgtcgcccgggatgctctgcgagcaggccgtctatctcagcgccgccgcgctcgccggaatcgggcgcttcctggtactgcgcctgttcgtcttcgccaccgaccggaaccggaaccggaccacgaccacgaccacagccacagccacagccacggtccgagcgacgagccctgcacggccgtgggacctgtcggaagcggggcgggcgcggggcacggagaccattgctgcgcgggtcaggtcctatgcctcggccgacgtcagcaggtgcggggcgagggcggcgaccgttcccgccctccggggaagctctcggtgccgggccatcaggcgtcccgcgcagggcagttcgacggtgcgcccaccgatctcctcaggccgcaacaggccgcaccggttcgccggtaggaaacgcgccgtgcgctgcgacccggctgggtcagctccggcgggcgggaccgaggccggcgcctcggcctgcggcgtgtgctgacgacggcgtcggccgaccggcgtcctcggtgccgcgttgcggtggggcgggcttggtctgccaggctgctcctggtgggcgccctcccgtcggggcagcggccgccgtgggtggggtgacctgcgcgcagtcggcgctcgcccgaccgcagcacggcgtccgaatcccgccagacagggcggccggcaggccgcagagttgatacgtggccatcaggacatcaccgagacctttgcaaggagcagaccgatgacggtctacgcgacgatcgacagcccgctgggcgcattgctgctggtgggcgaggagtccgccaccgccaagggcggtaccgcgctggcctccctgtccgtgccgggccagaagggcggcgcgaccgtccaggacgactggctcgagaaggcggaggcgttcgacgagatcgtcacccagctcacctcctacttcgacggcaggctgacccggttcgacatcgagtacgtcaccggcggctcggagttccagcggcgcgtgtggcaggccctggaggccatcccgtacggcaccaccctctcctacggcgacatcgccgcgcggatcggcgccccgagggccgcggtccgggccgtcggcacggcgatcggcgcgaacccgctgctggtcgtccgcccctgccaccgcgtgatcggcgcgagcggcgcgctcaccgggtacgccggcggcctggagcgcaagcggcggctgctggacctggagaacgcccaccgggacgcctgaccgggttcccgggtcccgggcccggtctccgatccgctctcccccggctcccgcgcccggcttcgtgttcgcgcagccggagccaagatggcgcccacgcccacagcacccgaggaacccgaccaccatgaacggcaccgctcatctgccaccccgcatcggcgaccgcgtcgccgagtgcgactggtccgccatcaccgacgaactcgacgagtacggcaacgcccccaccgggcagcttctcactcccgccgagtgccgcgggatcgcgaacctgtacgaggagcccgaccgcttccgctcgaccgtggacatggcccgccatcgcttcggctccggccagtaccgctacttcacccacgaactgccggacacggtcgccgagttgcgggcggcgttctatccccgtctgctacccatcgcccgcgactgggccgaacggctcggcacatccgccccgtggccggacagcctggcggagtgggtagcgctgtgccacgaggccggacaggccaggtccgcccagatcctgctgcgctacggtcccggcgactggaacgctttgcaccgcgacgtgttcggcgagatgctcttcccactccaggtcgtcatcggcctcgacgcccccgaagtcggcttcaccggcggcgagttcatcatgaccgagcagcgcccccgcgcacagtcgaggggttcgtccaggaccctgccccagggtcacgggctggtcttcaccacccgcgaccggccggtggcgagcaggcggggctggtccaccgcgccgatgcggcacggggtgagcacggtccgctccgggcgacggcacacgctcggcctcgtcttccacgacgccgcatgaccttcgccgcacccggacggaacagcggcacggccgacgtacgtgcacgctgctcggaccggacgggcggccgtaccgcagtagtacaccgggaaccctgggcggacagaagccgtcgaaggtgatcactcgacgcggcgctcacgacctggccctggcggtaggtggggctgcgggtctcctcgttgcccgagggggtcttcgccggtcgtcccggcgagggcctgtcctcacgtcatcgcgacgacgacctttccggccttcgcgcggcccttctcgacgtactccatggcctgtcgggtctccgcgaaagggaagacacggtcgacgacgggacggatcttcccggtgtcgatgagcggcgtgagttcgcgcagctggtcgccgctggccttcatgaacaggaacgagtacgtcacgttgcggcgcttggcgcggcgccgggtcctgaagctcagcgcgctcatcgccagtcgcaggattggcttcgcgcccagctcgcgggcgaaggccgggtcgggagggcctgcgatgctgatgaccttcccgccgggcttgagtacctgaagggacttctcgagcgtctcgccgccgagggtgtccaggacgacgtcgtagccgtgaaggaccgtctcgaaagcctgcttcttgtagtcgacgacgacgtccgcgccgagctccttcatcaggtcggccttggccgtgctcgcggtggtggccacgtgcgcgcccagctgcttcgccagctggacggcgatggtgccgacgccgccggagcccgcgtggatgaggaccttctgacctggcatcacgcgtgcccgctcgaccagcgcctgccacgaggtcagggccaccaggggtagggacgcggcctcctccatggtgagcgtggccggtttggccgccacgtcgtcctggtggacggcgatgagttcggcgaacgtaccgatgcgatccttgtcgggccgcgcgtagacctcgtcgcccaccgcgaaccgcgtgacggccgatcccacttggaccaccaccccggcgaggtcgttgcccaggatgagcgggagacggtacggcaggaacgccttgaagtccccgtcgcggagcctgaggtccagcgggttgacgctcgccgcgtggatctggaccaggatgtcgtcggcgcccacctgcgggtccggcatctcaccggcgcggacgccggctttgtcgccgtaccgctcgatcatgaaggtcttcatcgtcgtctccgttcctcgtccgcgaagggacgggatcgctgttcatcctgggcttctcccagggcgggacactttgtggtgtttgctccggccccttggagcccctcgccgatgcggcggacatccgccgacgcggcttctgcctgccgcgggcctcaagagcggctcggccaccgggagccagccgccatgccttcggcgtcaggccactggtgcgggccggcgggtcgtggaaaccgcgtcccgactgttccgggagcaaggcacccgcgtcagcgtcgccgacctcatgaaggcgtccggcccgacccacggcggcttctacaagcagttcacttccaaggaggccctcatcggcgaagccaccgcccacgcgttcgacgaactcgcccggctccgcaatgacggactcgagcagcatgccgggcagcgcgacgccgcccagcaggcactgatcgacaccaccgagggagtgagcgacttcgccgaatggctcaccgtcgaggaccgggacggcatcacccgtctgtgcaccatgctcggcgcactcatcccggcccgagccaccaaagacccccactctccgaggaaatcctcaccaccgcgcgcgcagcattgacggcaaccagctgatcgacgacagtcagccgatcaggggcacggcgccgggcagcagatccaagtcgcccgcgccagcgcgagcgcccgcccttgcctgctgcggcccacacccggcggcccacacccggcggcccacacccggtccaggcctgaaccggatcggcgcgccgatcggggtgcgcggcggacaggtactccatgacggttgtttcgcagacacgaacgagccgcgtcaggcgaaccgggtcgacggtgtggcgggctcgccacaggtacggccagcagtcgcggcatgccgttcgagcccgccggggccggccgcttacgcctgctgcggctgaccgtcccgccggctgtcatgctgggcgaggagggacagcaggtccgccacggtcgagccgttgtccgccgggtgccgcaggaaagtgcccggctgaatgcggtacgtattggaacgtccctgccgggtgtgggtgagatagccgccctgctccagatcggaaatgatcttctggaccgcccgctcggtgagtctgcagtgcgcggcgatatcgcgaatacgcacggtgggatcctcggcgatcgcagacagcacgcgagcgtgattggtcagaaatgtccagcctgtatgtgtctcaggtacgtcacccatgccgccaggataggacgctccattcgcgtaaaccaaagggtgaaattcgtttcatgtatctcttgacgggtgagacaccagagggtgagtctggacgcggagacgactggatgcctcaggagcggccgccatgtcagagcaagagctttcccagctgtcggggggcatggatgacgctgccccctgcccttggctgaaggtcgaggtacatccggccggcgaccggcaggttgtcgtggcgtacggcgacatcgacgtcgacaccgaagcgatcctgcaacgggctctgcgcgaagctctcgaccattcggtcagcggcgtgaacctcgatctcggcgccgtcggcttctgcgactgcgccgggctcaacgtcctgctgcgcatgcgtcggcatgctctggcacatggcaagacactcgccgtccaggccaccggcccggcgaccggaaagctgctcacgatcaccggcacactgtcactgttcgacgtcacggccggccccggcacgcgcgccaagggccggaacccgcttccaccggaaccgcacgacccgagccgagtcgaccacatcgacgggaccggccggggcagagacggaaccgacctggaaaccgacgggacaatcgacggaacagtggtcgacctgcgcatcgaagtcggtcagctgcggcgcgccatgcagacccggcccgtgatcgatctggcccgcggtgtactgatggcgtccttcggtctgagcgccgaggacgcctggaccgtgctggtcacggtgtcccagcacaccaacaccaaactgcaccagatagccgaggacctggtgaacacggtccagggagccccgctgcccgagccgttgcagcggcaactcgccgaggcggtcatgccgttcagccgggtacggaatgcgggggcgtgacggccctgtccgcggccgccgcaccgcgaccagcggggcacaagtgcgagtgacggatccgcaggtctcacacttcacctcacaccgcacaccgccgcacaccaccgccgcccccgcccgccgcccgccaccctttcgcgcacggcggggaaacgggcgtcgacgacgaatcccccgacggccgtcgagcctgtgcggatctgtccgccgacggccgcggcccgctcccgcatgccgagcaggccgtgtccgtcggcccgctcggtgtggggcggcccgggtccgttgtcgcggatacgcatgcgcagggcgtcctcggtgtagatgagctcgacgtcgacggcggcgcccggcgcgtgcttgcgggcgttggtgagggactcctggactatgcggtacgcggcgagttcgaggccgggttccagtgtgcgcggggagccggacaggatgaggcggaccgacgtcgatccggacgcctcgcgggcctcgtcgagcagttcgcccagccggcgcaggtccggctgcggtcgacgctcgccgccggtcacgggctccgtgtcctcccggagtacgccgagcagccggcgcatctcggtgagggccgcgcgggcggtgtccccgatgccgagcagcctgtcggcgcccacggcgggcatgccgggggtggccacccgggccgtctcggcccgcacggcgatcatggagatgtggtggccgacgacgtcgtggagctcacggacggtccgggcgcgctccccgcgtgcggcgttctcccactgggtgccggccatgacctgctggactgccgtgtgttcccgctggtgttcaccggtccgccggaccagtccgacgagtgcggccaccggcgcgagcgccgcgagcaggaccacccgtgtgcggaagtcggtgtcctgggacgcgggcagtgccagggcgaggaagggggcgccgagcagcacggccgcgaccgggtgaccgctgcggccgagccggtactgggcgacgcactgggcggcgaagcccgcgagtgtcagcgtctggaagatcacgagcgatccgaaactcgcggccgtgacggtgacgccggccggcagggggcgcagcagagccaacggcagtgcggtgaacagacacaacaggccgaccaccatggcgagttgcacacccgcgacgccgccgtcgcggacgcccgtcgtggcggactcggcgaacatccgcgggatcgatccgtgccccacgacgaattcggccagcgattccacgaccgcgaggagtccgagcagcaccgagaacacgccgcgcgcatgcggaagttcgacgccacggtgccgcgtcgtgctccaggtgtcacgccaggcagtcgcacggtccacgccggccattatcgcaatgggcgccggacgtgatcgtccctctggagagccagaacgccgtccctcggacgggggacgacatcggggcagtacgccaacaccgaggcagtacgccggggcagtacgccaacaccgaggcagtacgccggggcagtacgccaacaccggggcagtacgccggacatcgaggcagtacgtcggacaccggccccgcctgctcccgatcgcacgcccctgccatccaccccccgctatacaccacatgtatagctgtcatgtacattgcgagctatgccttctctgaccaagaagatgaaaagaccggggaccaggttccgtgcggccgcagtttgtgcggctgtcgtctccctcgccctccccctggcgggctgctcctcgctcgagaccaccgcgcccagtgccgcccgggcacatgccgccggggccgcggcccgactcgggaccgtggactgccggcagaccaagtgcatcgcgctgaccttcgacgccgggcccagcgagaactccgcgcggctgctcgacatcctcaaggagaagaaggtgcccgccaccttcttcctgctcggcaagcggcacatcgagaagtatcccgagctggtcaagcgcatggccgacgaggaccacgaggtggccagccacacctgggaccacaagatcctcacccggctcaagccggcggagatacgcgcggaactggaacggccgaacaaggacatagagcggctcaccgggcggcaaccgaccctgatgcggccgccgcagggtcgtacgaacgcgacggtgcacaagatctgccgggagctggggatctccgaggtgctgtggagcgtgaccgccaaggactacacgaccgacgaccccaagctcatccagaagcgcgtgctggcccagtcgagccgtgacgggatcatcctgctccacgacatctacccgggtacggtcccggccgtgcccggcatcatcgacgcactgaaggaacgcgggtacgtcttcgtcaccgtgccgcagctgctggcgcccggcaaggccgagccggggaccgtctaccggccctgacggacggccgggccacggggataccccgcgcggcgctcaccagaccaggtgcagactccgcggtgagcggtggatcagggtggggcgcatggtcacgggccggtcgtcggccggccgcaagcccggcaggcggcgcgtcaactgctccagtgtgagccgcagttgctcgcgggcgagctgcgcgccggggcagccgtgcacgccgaagccgaaggcgagatggcggcgcggggtgcgggtgatgtcgaactcgtcgggccgcggatgccgtcccccgtcgcggttcgccccgccgaaggccacgaacaccgatgctcccgccgggagttcggttccggcgagcgtgaccggccgggtggtgacacgacggaagccctggagcgcgctgtcgtagcgggcggcctcctcgatggccgcgggaatgcgctcgggctccgcgcacagcagctcccactgccgcgggtgccgcagcaggttcagtaccgtcgtgccgatcagggcggtcgtggtcaggtgcccggcgaggagcaggttctgcagatgcgccacgatgtcgtgccgctgatcgagcgtcagctcaccgtctcccggcgccacggaggcgatgatctcggaggccaggtcctcgcgcggatcggcacggcggtcgcgtacgaaggcatcgaggagatgctgcatggcgaccacgtcctgcgcggcaaccacctgctcgtcctccgtcagcggacggaagaggagctcttcggcgcggtgcccgccgtacacgacggccggcacgtcggcggggtcgaggccgacgattctgccgatgacgtcaccgggcagccggcgggcataggcggccatcagctcgacgcggccgctctccgcgccgctcaggaacctgtcgacgagggcggtggcgcgctccgcggcgtacggcagcacggcggcgacgcgcgcgggcgagagaccgcgcacgatcggcgcccgcagctcctgatggcgggcgccgtccgcggtcaccacgaccggacgcccgccgaaccctccgccgagcacggcgagggcggcgggcgcgggcatgacatcgggccgcagtgcgttggccgaggagaagtcgtcgggcctgcgcagcacctcccgtacgtccgcgtcccgcgccaccagccaggcgtccagctcggggacgtgctcgagggcggtgaaccgccgcgcccgcgcgtagtgcgggtaggggtcgcgctgcaactcgtcgagcctgccgtgcagttcgaggtccacggggggcgccctccggccacggatgcgggtcggccccatggtgccgtacaggtgtgcggggcggtaggccattcccggacgggcagggcgcggcccgtccgggcccgggtcagaacaccaccgtccacccctcgtgcgcggcctgctcggcggtgtacgagacgccgtgcaccttgaggccgtcggcgtccagcagggtgatctcgccgccatggttgcccagttgggctccgtcggagaggggtgcgctcagggtggcgcccgccgcgagcgggccgggcggcaccgggccgccgtgtcccaggcgatcgacgaggcgccagccggtgaggtcgaccggggcgggcgaggcgttgatgagcgtgacgctctccgtctcgggggccgggccgggcggattgaccagggccgccacgagacgcaccggctgcaacccgggctcggggcggggcccggcgacatcgagggcgtggccggtggcgtcgtccgtgtgccacttctggctctggaaggcgaggaacacgccgacccagcgcgactgggccgggaagtggatcagcagcccgccgtcctgccagactccgtcgtcgccctcgaagcgacggctgttgccctggttcatatggatgtcgtggacgccgttgccgggcaggaagtcgaagaccttgtcccggagctcggcctcgggtccccagcgctccccgaagacgtacatccgcgcggccggatcctccaccgcccggcgtacgtagtggtcgaggatgtcggcgaggtcgttgtcggggccctccacctccggcggaagcgtgcgcatcttcgacgggtcgaagagattgccgcggacgaagtcgagattgggtccgcccggccccgacggcagcttgctccacccgctcacgaggccctccagacgggccgtgatggggtgacggaagtcctcgtcgaccaggtagagcagctcggagggccgctcctgggacttgacgttgaccgaggcgcggtagtgcgtgccttgatcgtccgtcagatggacctggtagtgcggcgtgtcggtggaaccctcgcgacggacgtcgaccgcgcgtgcgatcagtacgccataggtcttcaacggcatgacgaccaactttccctgagagggacgggcggattgctcccccgagggaatggtagtgggatgtcatcatttgtcgctcagtcggttcatacattcaggggtcgggggagtcctcggtgatgcgcctacgatcactccgtggtcctcttcctcctcgaacgcgtcgcgccggtttccgtcgatcaggcctggcaccggctcacggactgggaacgccacgcggccgtggtcccgctgacccgggtcaccgtcgccacgccgccgccgacccgcgtcgggacgctcttcgtggcccgctcaggaatcggcccgctcgccttcgacgacccgatggaggtcgtcgcctggcagccgccgggggcgggcgccccggccctgtgccgactggcgaagaggggcggcttcgtcacgggttgggccgagatcgaggtgcatccctacggtgacggagcctcgcgggtggtgtggcgggaggatctgagcgtgcgagggctgccgcacgccttcgacaggcccctgggcgcggtggcccgacggatgttcggccgggcggtggacgggctactgcggcccggcccggcctcgtgagaaccccggaccgaacctacgccctcaccggcctcggccaccgcacgctcgccgtcgaccgggcgaaagcgtagatcaccgggacccgcgaccgttgtgcgggtcccgaacggcgcctcacggtccggcgaggacggtcctgcggtcgcagccgggttgtcagaccgccggtctacagtcgcgctccatgaccgagacctctcacctgcacaccacccggacgtcgtacgacgccgtcgcagtcgattacgacaggctgctcaggaaccatctggcgcacctgcccttcgaccgggccatgctgggagcgttcgccgagcgggtggtcgccgagggcggagggcccgtcggcgacctgggctgcgggcccgggcgggtgaccgtccatctgaagtcgctcgggctggatgccttcgggatcgatctgtcaccggagatggtcgcggtggcccggcagacctacccggaactgcggttcgacgtcgggtcgatgaccggactcgacctcgacgacggctcactcgccggagccctcgcctggtattcgctcgtccacaccccgcagccggaactgccgcctgtcttcgcggagttccatcgggtgctcgctcccggcggacatctcctcatcgccttcaaggcgggcgacgagtgcgtccacctggagcacgcctacggccacgatctgtccctggacgtctaccgcttcccgcccgagcggatctccgagttgttgcgcgaggccggtttcgtcgaggtcgcccggctggtgcgggaagccgacgcgagctgggagaaaaccccacaggcatacctgctggcacgcaagcccgcccagccgcgagccccccggccggatacgccagaggcctccacccgagacgcagcggcctcctgagccaccgctcaggccaccgacccgatccgccccgccatgctcgacgcggcgtcgtggtggatcggggtgtgggcgccggtcagggagaccccgctgccgccgcgacggcccgcgacgatctccgcggcgatggacagggcggtctcctccggcgtacgggcaccgaggtccaggccgatgggcgagcgcagccgtgccagttccagttccgtgacgccgacggcgcgcaggcggtcgttgcggtccaggtgggtgcggcgggatcccatcgcgccgacgtacgcgaccgggaggcgcagcgccagcttcagcagcggtacgtcgaacttggcgtcgtgggtcaggacgcacaggaccgtccggccgtccacctgggtgcgctccaggtatgtgtgcggccactcgacgacgatatcgtcggcctccgggaagcgcgtacgtgtcgcgaagacggggcgggcgtcgcacaccgtcacgtggtagttcagaaacctgccgatgcggaccagcgccgacgcgaagtcgatcgcaccgaagacgatcatgcgcggtggcgggacggaggattcgacgaggaccgtgagcggtgctccgcagcgagcgccctgctctcccgtctccagcgtgccggtgcggcccgcgtccaggaaggcgccggcctcccccgccaccgtgcggtccagttcggggtgggcgccgaagccgccctcgtacgagccttcggggcggaccagcagcgcgcgtcccagcagctccgcggggccggtgacgatccgtgccacggccgccgcctccccgtgcgccgcggcggccagcgcggccgcgtacaccggccgggcgggatcggccgcccggaccggtgtgacgaggatgtcgatgacgccgccgcaggtcagtccgacggcgaaagcgtccgtgtcgctgtacccgaagcgctccaggacggtttcgccgtcctcgagcgcctgccggcacagctcgtacacggcgccctccacgcagccgccggagaccgagccgatcgccgtgccgtcggcgtccaccgcgagggcggcgccgggctggcggggtgcgctgccgccgacggccaccacggtggccacggcgaagtcgcgtccccgctcgacccaccggtgcagctcttcggcgatgtccagcatctctcggtctcctttgactgcggttgcggtgggggctttccccgacgtttcccgacgtttcccgacgggcgtctagtggacgcccagccagctctctatcgggttgagggcgaagtagacgaggaagatcaccgtcaggccccacatgaacgccccgatctccctggccttgcgctgggcggccttgatggcgacgtaactgaggaccccggccgccacgccggcggtgatggagtacgtgaacggcatgatcacgacggtcaggaagaccgggatcgcggtgccgcggtcggaccagtccacatgccgggcgttcatcatcatcatggctccgatgacgaccagcgcggcggcggcgacctcacccgggacgatcgccgtcagcggggtgaagaacaggcaggccgcgaagaacaggccggtgaccacggacgagaggccggtacgggcgccctcgccgaccccggtcgcggactcgacgaagaccgtctggccggaggcgcccgcgacgccgccgatcgcaccgcccgcgccgtcgatgaacagcgccttggacaggcccggcatccggccctggtcgtcggcgagcccggcctcggtgccgacgccgatgatggtggccatcgcgtcgaagaagccggcgaggaccagggtgaagacgatcatgccgaccgtcatcgcgccgacctggtcccagcccccgaactcgaccttgccgaagatcgagaagtcgggcatcgagaccgcgccgccgtgcagttcgggtgcgccgctcgcccactgcctggggtcgatgacgccgagggcgttcaggacgacggcgaggaccgtgccggagacgatgccgatgaggatggcgccgggcacgccccgggcctggagcatgaagatgagaagcagggtcgcggcgaagagcaggaccggccagccggcgagttcaccggtcgggccgagggtgaccggggtcgccttgccctggtgcacgaagccggccttgtagaagccgatcagcgcgacgaacaggccgatacccatggtgatcgcgtgcttcagcgccagcgggatcgcgttcatgatcatctcgcgcaggccggtgaacaccaggagcatgatcacgacgccgtagatcacgcacatgcccatggcctgcggccaggtcatctggggcacgacctgcgaggagagcacaccggagacggagaggccggcggccagggcgagcggcacccggccggcgaaacccatcagaagcgtggtgcaggccgccgcaaacgcggtcgcggtgatcagggcctgctggccgagcgtgttccccgccgcgtccttgccggacaggatcagggggttgaggagcaggatgtacgccatcgccatgaaggtggtgacgccaccgcgcacctcgcgcgcgaccgtcgagccacgccgggatatgtgaaagtaccgatcgagccaggaccggccggccgggacgcgggttcccgcacccgcgtcgtcggcgacgctcctgggctccactgattgctgggtcatggtgccatctcccaaggttcacaggggcacccgcgtcagccaccctgatggctgaggtcaaccgccgttgcggctgcgggatttgggaaggtgcacgacccgggggacggcccgagacgaacaagggggctgtcggggggacgaagtccccccgggagcgctcgttacttaccggtcaggtgctccggccgtacgggcgtccggttgagttccagacccgtcgcgttccggatcgccgcgaggacggccggggtcgacgacagggtcggggcctcgccgatgccgcgcagcccgtagggagcgtggtcgtcggcgagttcgagcacgtcgaccgggatggtcggcgtgtcgaggatggtggggatcaggtagtccgtgaaggaggggttcctgaccttcgccgtcttcgggtcgacgatgatctcctccatgaccgccatgcccaggccctgggtcgtaccaccctggatctggccgatgacggacagcgggttgagcgccttgccgacgtcctgggcgcaggccagttcgatgaccttcaccagacccagctcggtgtcgacctcgaccaccgcacggtgcgcggcgaacgagtactggacgtggccgaagccctgtccggtccgcaggtcgaaggcctcggtcgggcggtgccgccactcggcctcgacctcgacggactcgtcgccgagtacgtccacgaggccggcgaggacctcgcccgcgtcggtgacgaccttgccgccctccaggagcagctcggcggtcgcccaggcggggtggtacgtaccgaacttgcggcggcccagctccaggaccttctcgcggaccagctcgcaggagttcttgacggcgccgccggtgacgtacgtctgacgcgacgcggatgtcgaaccggcgctgcccacctgggtgtcggccggctggatcgtcacctgtgtgacgcccagctcggtgcgggcgatctgcgcgtggacggtgacaccgccctggccgacctccgccatcgcggtgtgcacggtggcgaccggctcgccaccgaccacctccatccgcaccttggcggtcgagtagtcgtcgaacccttcggagaagccgacgttcttgatgccgaccgcgtagccgacaccgcgtacgacgccttcgccgtgcgtggtgttggacagaccgcccggcagctgccgcacgtcggcgccctcgctgctctcccactgacgctcgggcggcagcggcatcgccttgacgcggcgcaggagttcggcgaccggcgccggggagtcgaccggctgtccggtcggcaggagcgtgccctgctccatcgcgttcagctgacggaactcgacccggtccatgcccaccttgtcggcgagcttgtccatctgggcctcgtacgcgaagcacgcctgcaccgcgccgaagccgcgcatggcgccgcacggcgggttgttggtgtagagcgcgatggcctcgatgtcgacgtcgtcgatgacgtacgggcccgcccccagcgaggacgcgttgccgacgaccgccggggaggccgacgcgtaggcgccgccgtcaaggacgatgcgcgccttcagatgtgtgagcttgccgtcgcgcgtggccccgtgctcgtaggagagcttcgccgggtggcggtgcacatggccgaagaaggactcgaaccggttatagacgatcttgaccggcttgccggtgcgcagcgccagcaggcaggcgtggatctgcatcgacaggtcctcgcggccgccgaaggcgccgccgacaccggagagcgtcatacggaccttgtcctcgggcaggccgaggaccggcgcgatctggcgcaggtcggagtgcagccactgggtggcgacgtagaggtcgacgccaccgtcctctgcgggcacggcgaggccggactccggtccgaggaaggcctggtcctgcatgccgaaggtgtactcgccccggacgatgaagtcggccttcttggcggcctcttcggcgttgccgcggacgatcggctggcggtgcacgatgttcgggtgcgagacatggccgatgtggtggtcggtgcggccctcgtggaccaggatcgcgtcgggcgccgtcgcggacgcctcgtccgtgatgaccggcagttcgcggtattccaccttgatcttggcggcggcgcggcgcgcggtctccgggtggtcggcggcgacgatcgcgaccggctctccgtggtggcgcaccttgccgtgggcgaggaccggggtgtcctggatctccagaccgtagttcttcacgtcggtcggcaggtcgtcgtacgtcatgacggcgtagacgccgggctgcgcgagggcctcggaggtgtcgatcgacacgatctcggcgtgcgcgaccgtggaacgcaggatctggccccagagcatgtcctcgtgccacatgtcggacgagtacgcgaactcgccggtgaccttgagggtgccgtccggacggagcgtggactcgccgatgccgcccttggacttggtgccctgcgtgattttggtgggcgtacccgtggttcccatggtcagaccgcctcggactgccgggcggccgcgaggcggaccgcatccatgattttctcgtaaccggtgcagcggcagaggttgccggagagcgcctcgcggatgtccgcgtcggtcggcgtcgggttgcgctccagcatctcgtccgccgcgaccagcagacccggggtgcagaagccgcactggacggcgccggcgtcgatgaacgcctgctggatcggcgagagcgccgcacgcggggagacgccggtgccctcgccggtccgggagtcgcccggccgggactcccaccgctgggcgtcctgaagcgacgtaccgcaggaaccggtgccgcaggagcgctgctcggcgtagtccgcgaggccctcgaccgtgatgacctcgcggccctcgacctggcccgccgcgaccagacacgaacacaccggcacgccgtccaagcggaccgtgcaggagccgcactcaccctgctcacaggcgttcttggagcccggcaggccgaggcgctcgcgcaggacgtagagcagggactcgccctcccacacgtcgtcggcttcctgcgggcggccgttgaccgtgaaattgacgcgcattacgcgacactccccttctgatgtgtccgaccgtcagcgccgcggtacgtctcccaggtccaggtcagcgtgcggcgggccatgatgccgaccgcgtggcggcggtagctcgccgtgccccggacgtcgtcgatcgggttgcaggcggcggagcacaggtccgcgaactgcttggcgaccgagggggtgatgatctttccgttgtcccagaacccgccctcctcgagcgccgcgttcaggaactcctcggcggtcttggcgcgcaccggggtgggcgcggcggatccgatgccggtgcggaccgtgcgggtctcggggtgcagggccaggccgaaggcgcacaccgcgatcaccatggcgttgcgggtgccgaccttcgagtactgctgcgggccgtcggccttcttgatgtggacggccctgatgagctcgtcggcggccagcgcgttgcgcttcacgccggtgtagaagtcgtcgatcgggatcagacgcgtgccgcgtacggacgcgacctcgacctcggcgcccgccgcgagcagggccgggtgggcgtcaccggccggggaggcggtgccgagattgccgccgacgccgccgcggttgcggatctgcggggaggccacggtgtgggaggccagggccaggccgggcagctcgccgcgcaggctctccatgatctgggtgtacgggacggaggccccaaggcgcacactctcctcgccgacctcccactcgctcagctcgccgacgcggttcagatcgaggaggtactcgggccggcggtggtcgaagttgatctcgaccatcacatcggtgccacccgcaatcggcacagcggtggggtgctcggccttcgcggcgagcgcctcctcccagctggcggggcgaaggaagtccatgaccggctctcttcttcgttttgtgggtcgttctgtttgagccagatcgtgtgcggcggcccgggctcgttcatgtgctgttcacgcggatgggagtcagtacaccgctccgtcctccggtggggtcagtcaccgaaaccatgaaggagttggctggccagggcagtcatcttgtagattcgtatgaacggaggccatcagtaacctcttggtcttcctccggaaacagtgagcacagctttcgaaagcccaggacacagccccggagggccggggccaccgttctccggcatccgcggacccactccacggagccctgggatccgcttggcgggttctcaccttcagttcatcgtagatttcgagacaagaacggcggcgacgagaatgcggctgcgcgcactgctggacaccgacgcgctgggcctgcggctgctcggcggcgagggcgagctggaccgcaccgtacgcggtgtgatgaccacggacctcaaggaccccagccgctacctgtcgggcggcgagctggtgctcacgggcctggcctggcggcacgacgccgccgacaccgagcccttcgtgcgcattctcgcgggcgcgggcgtcgcggcgctggccgccggtgaggcggagctgggcgacatcccggacgacctggtcctggcctgcgcccggcaccggctgccgctgttcgccgtcaacgagtcggtggccttcgcgacgatcaccgagcacgtcgtacggcaggtctccggtgagcgggccggggacctcgcggccgtggtcgaccggcatcggcggatgatgacctcgggcccggcgggcggcggcccggacgtggtcctggacctgctcggctccgacctggacctgcgcgcctgggtgctctcccccaccgggcggcccatcgcgggctcgaacctcagcggcccgctgcccgccacggacgtgtgcgcccggctggccgccgagcacctggcggcggcgcgcaccgggcggcgggggccgcaccgcgtgctggtaggcacgacgacgtactcgctcttcccggtccacagcagcggccggtccaccggcgcctccagggacgtacgcgagacggtgctgtccgactggctgctcgccgtggaggcggacgccggggactggcccgccgagcgcctcgacctgctccagggcgtcacacagctcatcgcggtcgagcgggaccggcgggacgcggcgcgcaccgtgcggcggcggctcgcccaggaggtgctcgagctggtgcagaccggtgccgcgcccgccgagatcgcggcccggctgcgggtcgccgcgccggtgctgctgcccggcctcgggtcggcgccgcactggcaggtcgtggtggcccgggtggagtgggacggcggggagatcgagggcggcccggtcgcccagtcgctcctcgaggagatcctcgtcgacccgctgtcgaccggagccgagcactccgatcgcatcgccgtggcccatacgggtgaggaggcggtcgcgctcgtcccccttccggcggtttcctcggagcacgacggctccgaggccgggctgctcgcggacaccctgctggaggccgtacgcgacccgctgtccgcgggcctgaacgacgacgggcggctcacgctcggggtcagcgcggccgtgcactccgcggaggggctgcgcggcgccctggaggaggcccggcacgcccgccgggtggccgccgcccgccccggccgggtctgcgcggcgggccaccaggagctggcctcgcacgtcctgctgctccccttcgtcccggacgacgtgcgccgcgccttcacggcccgtctgctcgaccccctgcgggagtacgaccgccgccaccgcgccgagctgatcccgaccctggaggcgttcctcgactgcgacggttcgtggacgcgctgtgccgcgcgtctccacctgcacgtcaacacgttgcgctaccgggtgggacgcatcgagcagttgacgagtcgcgacctctcgcgcctcgaggacaagctggacttcttcctggcattgcgcatgagctgaggtcacggcactgtgggcccggtggcaccaagtgccgccggtgtcccacgactttgtgaaatccttcacccaccctcttggcccggccccgcgattcgtgctgagatgccgccaccactcaacagctcaatggcgtgctcggggagggcaacgtggcgcataccgccatgtctggtcacggaacgactgcaggggacgatccactccagaccgcggtatggcggctgcgctcgcgcgcctgctgggccgacgcggccgcgctgctcgaaccgcgcaccgcgggcgcctcgctccagcgggccgcgctgctcgtcgagcggtgcctctacaccgagcagggctggcaggaggccgaggacgcgctgcgcacggccgaggcgcaggcccggagcgacgacgagcggggcgcggcggcctgtgagcgcgggcagctcgcgtacgcggccacgctgctcggggtgcgcgaccgggccgacgaggcgcgggccgcgctcggccgggcggccgcgctgatcgcgcccggcgctcccggccgggcgctgctggacttccggcgggggctgctcgccgagaacctggcacgctccccgcaggccgcccgcgccgcctaccgccgggcccacgcgggcgccacggcccacaacgacccgctgctgctgtccttcacctggcgtcatctggccggactcgccctgcgcgacggtgagctggccgaggcgcggcacggcttcggcgaatcgctgcgcatccgcgaggagttgggctacctcgtcggtacggccccggcactggcgtcgctggccgacgcggagacggagccggaggcgtcacgcctgcgcgccgaggcgggacggctgttccggctcctggggggcgtaccgacctggctggcccggcagttgacgccaccggcggccacggcgtaggtgtgccgtcccggccgcgggtgacgggatccagggtctgtccggtctgatccgccggacaggtcctggcggtcctagccgttccgggtgtcagcccacaggccctggacgtaggcgcccaggttctgggcgaacgtccagagttcggcgcggagtccggggttctcggccaggaggacgactacggccacgaggagcaggagcttcagcacaccggcgagaccggaagcggggcggccccggttccggcggcgccggcggtcgtactgggccgcgttgttactgaagacctgctggttcgttcgcaactggttctgccaggcaatctgctggccagggttgggaaccatcgtcactcacccccgagggattcggccgccttgtgaacggggacacatgagcggccgaggagcgggttcccccggggcgcgggccgttaccgcgcgtcgacgcaaccgtgacaccggctcggtgaacggcacataccggctacccgcccgcgaagtgctcccgcaccagggactgcaccacgacgaggtcctgcgcgatcagcgcgtccagcagtgccgtgtgctcggcggcgtcggcgagcaggtcggcgcggccccgcgagaccgggccgccgacgaggggccactgggcgcggcggtgcaggtcgtccgcgatccgcaccagctgctcgttgccggcgagcgcgagtaccgcccggtggaaggcgcggtcggtctcggcgtacgtcgcgcgacagccggtggacgcggcccgcacactcgcctcggcgagcggccgcagctcggcccactgccccgcggacaccgtacgggccagccgcagcatcaccgggacctcgatcagtccccggatctcggcgagttcggccagctcgcgggccccacgcacgacgacgcggaacccgcggttgggtacgacctcgacggcaccctcgagcgcgagctgctgcatcgcctcccgcaccggcgtcgcggacaccccgaaccgctcaccgaggacgggcgccgagtacacctcgcccggcgccagttcccccgcgaccagcgcggtgcgcagggcgtcgaggacctggccgcggacggaggcccgctggacgacgggccgcgcggcctgggcgacgggcaggggcggctcgccgtgggtgtgctcaccgcgcgccgagccaccggccgcggcggcgccccggtcacgttcccggtcgcgggcgcggtcacgttcccggtctcgctcgcgttcccggtcgcgctcgcgacccacctcggcggcccgtggctgcggcggcacccgaacggccgccttgcccatgtccggaattccggtcccgggggaaccgtgcatgtcacgcgggcgcggaccggcctgctccacgggctcctcctccggacttgactgatctcgacagtacttggcgcacttggcccacttgggatcattgcggcggttgttaccgcccgtaaagcaccataagcgcagcgggcgggagttcaaacccgatcagcttggataaggtaagccttacctgtcaacgatcgtgaagtcggtggtccccgcatgccctcgcccgtcgcggatgcctacgcaaggctgaccgaggcctttcccgggctggcggtcacggagctcgaccccggggaagcggcccccgagggcgacggctgggcctccgccgccctgctcgcggcgggcgggaccggcctcgacgccttcctggcctgggacgaggcgcaggtcctgagggactacggacagcgggggcgcccggacgtcgtggccggcttcggactgcaccggtacgcctggccggcctgtctgctgatcaccgtcccgtggttcctggggcgccgggtaccgcgcctgcctgtggagcacgtcacgttccagcgcaccctcggccgcatggcgatacgggtcacggagttcgcctgcctgccggacgatccggcggccggactgcccggcgcccgcgtcgtaccggacgagcaggccctgcgggccgaggtacgggcggcggtcacggaacatctggagccggtcctcgggggcttcggtccgcgtatgcggcggcgcgggcgtgccctgtggggcatggcgaccgacgaggtcgccgaggggctctggtacgtcgcccacctgctcggcgaggaggagcgcgccgtccgggagctggaactgctgctgccgggcgcgacccggccgtacgtcggctcggccgcgttccgtgagctgaccggaccgaacggcgaggcgctgcccacccgcgaccgcgcgagctgctgcctcttctacacgctgcgccccgaggacacctgcctgacctgcccgcgcacctgcgacacggaccggatcgcgcgactcacggcggtcgcatcgccaagttgactgctgaggcgctcagttgacggacactcagacaagggacaccccgtcatcccgtaagatcggcgccgaccgagaccccgcgcggactacaggcaattcacaacttcctcacttgccacgggaactttccgcggaaccatccgtacgggtagtcttattcgcactcaactcccgtccctcgcgcggcagttcgagcagaatgtcgccctgcgcatccccttgcactcccttggcggcctcttgccccgaaaccccctgagggccaacgggagtgggccactatggcgggcgttacgccctatcccaatgcaagggaccccagatgagattgaccgacatatcgctgaactggttgcttccgggcgccgtactgctcctgggcatgctggcggcggtggccgtgctcgcgcgtggcaagcggtccggggagagctcgacgaatgccgacgactcgtgggagcgcagcgaggagcgccgcaggcgcaaggaggccatctacggcacggcctcgtacgtactgctgttctgctgcgccgcggtcgccgcggcgctctccttccacggtctggtcggcttcggcgagcagaacctcggcctcaccgacggctggcagtatctggtcccgttcggcctggacggcgcggccatgttctgctccgtgctcgcggtgcgcgaggccagccacggtgacgcggccctcggctcccggatactcgtgtggacgttcgcggccgcggcggcctggttcaactgggtgcacgccccccgaggtatcgaccacgcgggagccccgcagttcttctccggaatgtcgctgtcggccgcggtgctcttcgaccgcgcgctgaagcagacccgccgcgccgccctgcgtgagcagggcctggtgccgcgtccgctgccgcagatccgcatcgtccgctggctgcgggcgccccgtgagacgtacagcgcctggtcgctgatgctcctggagaacgtgcgcacgctggacgaggccgtcgaggaggtccgtgaggaccgccgccagaaggagcagaaccgactgcgccgccgggagcaggagcgggtcgagcgggcgcacctcaaggcgctcagccgcggccaccgcggcctgccgggccgcggtggtggtggcggcggacggcagctcgaagcgccgtccgtggaacgcgcgcccgcccaggtcacttcggaacctgctatatccacggaacagctgccccccgtaccgtcccgcccctcgcttcagcccgtccgcaactccgctgacccgatcacggtcgacctcaccgcggaggacgacaccatggctctgccccgcctcgactccctggagcgcaagctcaaggacctcgagcggcagttcggctagtaccggactgcgaacacgcggcagttcggcgtgaactgcccacactggcacgggggcgcagcctgttcaggcggcgcccccgtccagttcgaaccacaccgccttacccaccccgtgcgcccgcacgccccacgcgtccgcgagggactgcaccaggagcagccctctgccgtgcgtaccgtcgtcggcgttcggtacccgcggtatcggcctgcgccccacgaagtcccgcacctccacgcgtagtccgcgcggggagacggtggccgtcaggacggcgtcatggtcggtgtggatgagcgcgttggtgacgagctcgctcgtgagcagctccgctatctcggacttctccggccttccccagtgcctgagcagctcccgcagggcccgtcgggcctcgggcaccgcccgtagatccgcccgtgccagcctgcgcctgagctgcgtcccccctggctggtccgtcgtgctgtcggccgattcctccactgtctttgccgaggaggccccgattgccacgggaccgccccctcgcgcctgcctcttcatgacccccgcccggacgtggatgtcgaatcccctcctgctcgaacacgttcacggggatccatgccccgtccggaacgtgccagtcatgtcgaatagtcaacgaccgaacgtacgggcgcggacacgctccgctcgtgcgggggtcggggccgcccggtggaggcgggccgatggggggaggcaccgggcggcgctgggcagcacggttcggccgctggttcgtccgcgaggacgggcacggcgtcgtgcctacgtcgccgggtgtcgcactgaccgtacgggatcggcccaactgccgagttcgggctgacgacgaggccgtagccgaggggctccgcccgacgatgtgcggagccgtccgcggccgtggagggcaggcgtccgcacggcacacgggaggggccccgcccggtgccgacgttgcgtcggtctgaaccgggcggggcctgggtcgctctgtgccgcggggcggccgaacgccggctgctcgcggactacttgccggacactggccgaccaggccggggccgacctcctgccgactacttgccggctacttgccgccgatccccttcgttccgatgtggaagatcttgtggctcctggtcatgtcgacgatgagcttggtcgtcctcttgtcgccccaggtcagcgtgacggcggcttccgtgtggtccgcggtgccgttgtcggtcaccttccaccggaccgggacgttctgggcgcgcaggacgccgtccgcgtggttcttgtcctcccacgccttcaactccttgaggtaggaggcgctcacgtagtacttccggagcgcgtccaccagcttgccgccgttgtcagggtcgctctgcgcgtcgatgtaggcgccgtagaagtcggcgatccgggtcaccgagtccgacggcttgccgctgatcgaccgcggctgatccgtgccggcggacgcctgtgccgaggcggtgagccccagcggcagggcgagagcggcggcgagtccgacggccagggcggcgcggcgggcgggtcggcgggcggtggtgctgttcatttcgtgtgtccccgtttctcgttggtgcttcggtgctgcgccgggtcagcagggattgctgtgccgggtcagtagagcttgttgacggcggtggtcgtcgtcttcttgaaggcggtcaccggcgcgtcggtgaagtcgcccagctgcgcccactcgacgaccgtgacggccctcccgtcccggccgaccgagaacaggtggatgtcgccggcgccccaggaggtggcggtgtggaggccgtacacatgggcgccctcctcgaccggcagcctgccgtagtccttcagcacggcgtcggtctccgggtcggaccgctcgatccgcgtcgcgcacgaccggatgtcctggttcagcctggcggtgcggcccttggccgtggcctcgtcgccgagcaccatggtgagctgccgtgcgctggtgtcgaggtcggtccggtacgcgcgataccgggagtcgtcgcccggcagcgccgcgtccaggcagagccgcagctcgtccggtacgccgtccgtgaccttgcccgccgtccaggaggaggtcggatgcggcggcagttcggcggccgagaggaacgcgggcgagccgcctccccgtatcgccgcgccggccgggccggcgaccgccgtgccgagcacgaggcccgcggcggtgagtgcggtgagcgccgcgactcggacgcgcttggtcatgggtgtcccccgtatctgtgtgcatgggtgtcggatgccgtcgcgacggcccgttcgcgggctgccgtcgggaggtcggtccggcggcggtcggtacgacaccaagagcatcggccgtcccgtccggcatccgcaacagctgacggaggatccgccggggtggaaccgtcccagcccttctgacgtgcacatatatggagtgcctgggatgccgtcccgggacggggcaggtccgtcggcgcagacctccacggccgtggtcctggaggcactcagggtgcgggtgatcgggcgcgacgcccccgcccgaccgtccgctcgctcgcgggcgctgacagcgagaagacgatcccggcgatgcgcatgccctaccgggtgtccgcgcaggaccccgaggtgctgctggtcaaggcccggaccgagagctgcgactgccgctggaggacgcggcacgttccgctgcctaaggacgcggcacgttccgcaggttggagcgggccatctgcaccatccggccgaccccgccgtccaggaccatcttcgacgcggacagcgcgaagcccgtcaccatctccgcgctgatcttcggcgggatggacagggcgttggggtcggtcacgatgtcgacgagggccggtcccttgtgcctgaaggcgtccttcagggcgcccgcgagttgcttgggcttctcgacccgcacgccgtacgccccacacgctctggcgacggccgcgaagtcggggttcttgttcgtggtgccgtacgagggcagcccggccaccagcatctccaactcgaccatgctcaaggaggagttgttgaacagtacgaccttcaccggcaggtcgtactggacgagggtgaggaagtcgcccatcagcatggcgaatccaccgtcgccggacatcgagacgacctgccggttccggtcggtgaactgggcgccgatcgccatcggcagcgcgttcgccatggagccgtgcgagaacgagccgatgacgcggcggcgtccgttgggcgagatgtagcgggccgcccagacattgcacatcccggtgtcgacggtgaacaccgcgtcctcggcggccagttcgtcgagcacggaggccacgtactcggggtggatcggaacgtgcttctcgaccttccgcgtgtacgccttgatgacaccttcgagcgcgtccgcgtgcttcttcagcatcttgtcgaggaagcgccggttctccttgggcttcacccgcgggatcagacagcgcagggtctcccgcacatcgccccagacggcgaggtccaacttcgagcgccggccgaggcgttcggggcggacgtcgacctgtgcgatcttcacatcggtggggaggaaggcgttgtacgggaagtcggtgccgagcaggatcagcagatcgcactcgttggtggcctcgtaggcggcaccgtagccgaggagcccgctcatgccgacgtcgtacgggttgtcgtactggatccactccttgccccgcagcgcgtgcccgaccggggacttgatcttctcggcgaactccatgacctcggcgtgcgcacccgccgtgccgctgccgcagaagagggtgaccttgtcggccgcgtcgatcaacgcgacgagcttgtcgatctcggtgtcgccgggccggaccgtgggccgggaggtcacgagggcggtctcgacggccttgtccggggcgggctcggaggcgacgtcgccggggagggtgacgacgctgacgccggactgacccaccgcgtgctggatggcggactgcagcagcctcggcatctgcttcgggttggagatcatctcgctgtagtgactgcactcgcggaagagctggtcgggatgggtctcctggaagaatccgaggccgatctcgctggaggggatgtgcgaggcgagggcgaggaccggcgccatggagcggtgggcgtcgtacaggccgttgatgaggtggaggttcccggggccgcaggagccggcgcaggcggcgagcttgccggtgatctgcgcctccgcgcccgcggcgaaggcggcggtcccctcgtgccggacgtggatccagtcgatggcggagttgcgccgaatggcgtcgacgaccgggttgagactgtcacccaccaccccgtacaggcgattgacgcccgcgcggacgaggatgtcgacaaactgctcggcgacgttctgtttggccatggacccatgcaccccttctgtctccttgggtccatcaatccacagcgaccgcgatcacgcctcccaaacggcggccgctgtccggtcgtcggcgtaccccttgacccggacctgggtgtccgcgaggaaggcggcgaggccgggcggcccgccgttcgaccagcgtgcggtcaggtgctcggcgagtcgcggctccccgcgcaggggctcggcgaggccgccgctgcacagcaggagcgtgtcccccggatgggctacggaggcgcggaagcggaaggggtcgcggggcggttcgacgggggtgcctccctgctcgagcgaagccgagagccggggggacggttcgtacgggctcggcggcgtcgtgatgccgaggtccatggtgagccggtcgccctcgggggtctccgacgggagcgagccgaatccgaccacggcttccccggtcgcgtcggcgacatgcggctcgatgtcctgccatgcgccgtcccgcagccggaacagtccgccggcgccgacgccgaagaagacgcgcgtacggcattcggggtcggccggcagcaggagacagcgcagcgtggcggagtactcctcgggctcgacgccctgctccgcggcgctggcgcgcagcttgccgaggctgcggtcggtgagccggtgcaggcccgacttcaggtcgccgcgccgggcggcccggatgtcctcggcgagccgggcatgactgcgtcccacggctcgcccgatccagtggcaggcctctgcggccgcccggtgcgcgccgggcgtggcccgcgctccggtggccatggcgacgaggaggagcgcctggtcgcccacgccgaagcgggcggtgagcagggagtcgcggcgcggctcgccccggtagcgcgccgagtcgccgcgcgcggagacggcgcgcagcgtgcaggacccgtaacgggcgccgtccagcacggtgtccgcgaccaggtcgtcgaggtcgtccgggtcggcggccgggagggcggtgggttcggcgtcgtaggtgggtggcccggagccgatgtggtcgaccggcggcggctcgtggacgacggtgagggtggggtcgcgcggggggaggtcggggagcggcgggaggccgggggcttccactggcgggggcggcgcggcggcgcgagccaatgacggcggggggaggtcggggagttccggtggcgggggtggcgcgtcggtgggggccggcgcctcggtgggggccagggacggcgggccgacgggcggcgccggcgggcggagcctgcccagttcggcctccactggtgggggcggggcgtcgctgggggacaaggcctcggccggggccggttgcggcgggccgatgggcgagggcggtactggaggacgcggcttgaccggctcgcccggcctggccggggccgaacggccgggattcaccggctcgacgccgccttccccggccggggaaggcgggggcgcgtccgggcggagccccgggggccgccgtccgggcgggaaggtcgcggggcccggcggacgggcggacgggggttcccaaggggcggggtcgcgggccgggacgtcgcgtcgcggcggatcggcgtggcgtccgccggaaccgacggctcccccagcgccccctgcttcccctgaggcgtcagctccccctgctccccctgaggcgtcggccgctccggtcccccgcgtcgcggcgccggcgtgccgcccgggggatccgctcccccgcgccggggcagcgggggattcgcttccccgcgccggggcagcgggtccgccaccggcccgctgctccggtacggacggcggcgccgtcggtggtagcggggcaccggccgtgtcccggggtgccggctggcccaccgtcccggccgccgaggcgaagcggtcgtcaagggaatcggcggcggccgccggtcccgtgtccgccgtggagtcgtcgtacaactgcccccaccagtcgtcctcgtgaccggtggacctctccccctgctggctcatgccgccaattgtccaccgctcgggccgtatgaaaacggggcatccggaaaaaccggccacgcaactggttcccgaacggcgtgtcgggcgacatctcgaacgacggtacgaggcccgtcacccggaagtgaccgccgggcggttccaccccccacgggagaaccacccggcggcgccggaggggccgggcccggcgtattgccgggcccgagtcacgtactgcacgaccgcgacacgtactgcacgaccgcgtcacgcaccggacggccgacaccggcgtccacaccggcgccgacgtcggcctggcagggcccgagtgtgccccgctttgctggggatcggctgtggtccggtccgtcgcacgctccgtcccacgctccgggaggtcgctccccgtccgcgcggcggccggtgggccggtgtccgtgcaggccaagcaggttcgggccggcacgggggtgcgatcgatcccgcggtggcgccaccttggcagagtgaagggtggtacagcgatgatgtgccgaggcgggtttgcgccgtggccgttttccgccacggcgcggccggaaacgaggcctcgcacggggagggatcttggggagggacgtcgccgcatgctgggagcgataggtctggacggggcgcacgagtcggcgtaccgcgcactggtgtccatgggcgccgccgacgtgcccgatctcgcgcgtcggctcaccctcggcgagtacgacaccgagcgcgccctgcgccggctggaacggcacggtctggcggcccagtcgtcggcccgccccggccgctgggtggccgcgccgccgggggtcgccctcggcgcgctgctcacccagcagcggcacgagctggagaaggcggagctggcggccgcgctgctcgccgaggagtaccgggcgcaggccaccgagccggccgtgcacgacctggtcgaggtggtgatcggggcggcggcggtgtcgcagcgctttctgcagctccagctcggcgccggcgacgaggtgtgcgcgctggtcaccggcaccccggtcgccgtctccggaatggagaacgacgcggagaagcaggccgccgaccgtggcgtggcctaccgcgtggtgctcgagcgggaggtcctcgaccagccgaccgggatcgtcgaactgtcggccgcactgggccgggacgaacaggtgcgggtcgtggacaaggtgccgaccaagctggtgatcgccgaccggacgctggcgatggtgccgctcacctcgcacgccgcggaaccggccgcgctggtggtgcacgcgagcggcctgctggagctgctgtccggcttgttcgagtcggtgtggcggggggcgctgccgctgcggttgagcgccggtggcgcggtcgacgaacaggaggccgacggccccgacagcaccgatctggaggtcctgtcgctgctgctcgccgggctgaccgacgcgagcgtcgccaaacagctggatctgggcctgcggacggtgcagcgccgggtgaagcggctgatggagctgaccggcgtgacgacacggctccagctggggtggcacgcgtacgagaagggctgggtggcgcgcgactgacctgcggtttcccgtggggtccggcaggctgggcagatgggagcgtggaaactcctgccggtcggcgtggtgctgctgctcggcctggccggagtgctggtgcccggggtgccggggtcgtggctcgtctgggccgcggtcctttggtggacgctgaaggacccccagcccctcgcctggggcgttctcgtgggtgccacgctggttctgctgctgtcccgggcgatccgctggtccctgccgccacgtcggctgcgggagagcggcgccactccccgcatgggggcgttcgcggggatcggcgcgctgctcggtttcgttctgctgccggtgatcggcgcgatacccggcttcatgggcggcatctacctctccgaacggctacggctcggccggcaccaggaggccgtggcggcgacgcggaccgcgatgcgttcgggcggctccagcgtgctgacggagctgttcgcctgcctgctggtcgcgggcgcgtggctgggcgcggtgctctggggctgagtgcggtctctggagcagagtgcggtcttggagctgagtgcggtctctggagcagagtccggagcgtcggcggagccgatacatcggacccgtcccgggtgcgggtgcgccggggcggaacgacccactgggagcggccggtcggcttctcatcgccactcggtcagcgtcgcgaggtcgatcgtgtcggccagcgcctgcattccccggtcgttgaagtggaggtggtcgccggggtcgtaggcggggcggatgcggttcgggttcgcggggtcacggacggcggcgtcgaagtcggcgaccccgtcgaagaccctgccggtgcgcaggagcgcgttgaccgcctggcgtgccttctcaccggctccggtgaaggaactgtggccgccgtacggggtgatggtcgcgccgatgacgcggatgccccgggcgtgcgcgcgggacacgatcgtccggtacgcccgctcgaaggcacccggatccgtctgcgcgggcgtgcccttgatgtcgttgatgccctccaggacgatgaccgcgcgcaccccggagcggagaagggcgtcggcgtcgaggcgggccagggcgctggggcccacgccgtcgaggaggacgcggttgccggagatgccggcgttcagcacaccgagccggcggttcggcggcagcgcgcgcaggcgggcggcgagacggtcgggccagcggcggttggcgctggcggaggagccggtgccgtcggtgagggagtccccgagcgcgaccacgctgccgatggccgtggtgccgaggacgtcgacgccggtgacgtagtaccagtgggagacggtcgtggtgtacgcggagccgtcggtgtcggcggtccggtcgccgttcctggcgaggaagttggtctggaaggccgagcggtggtaggtcgcgggacccgagtcggccgaggtgtgcacgctgacgacgaggttggcgttcgccgggacgttcaggcgcacggcgtcggtggcccgctcccggcccgccggaatcgacacggaggtggcgcccgcgaaggtggcggtgcgcatggaacccggcacggcgtcgggactgcggggagcgcccggccgctgcaacgcgacggtgacggagtcgagttggaggggtgcggtgccgagccggttggagatccgcacgcgcagcgccgtgccgccgacgctggtgtgcaccacgttgcggatcgaggtgccggggagggcgggggtggttccggagggggcggtttcccaggtgccggtccagcgaggggccgaggcgggcggggcgacgccggaggcggtcccctcgtcggctcccaccgccgtaggggcgagcaccagtgctgtcaccagggcggcgaggaggtgccggaccttgatcgcgcgggtcatgcgggcatgatgtcccaccccgccgacccctccggcgcggcgtcacgccattggccgcaccgcacatacgtcccagggtgacctggacctaggtcgggaagccgatgcggtgggggcgcgtgagtgtttggctgctgtcatgaccgaattcagcgaggccgagcgcgcgtacctgaagtcgcagcggctgggacggctggccaccgtcgacgcccacggacagccgcaggcgaatcctgtcggcttcttcccgcaggacgacgggacgatcctgatcgggggctatgcgatgggcggcacgaagaagtggcgcaacctgcagaagaacccgaaggtggccctcgtcgtcgacgatgtgatcagcgtcgaaccgtggcgggttcgcggcgtggacatccgtggcgaggccgaactcctcaccgggccgcacgacttgggtccgcacttcagcgaggaagtgatccggattcatccgcggcggatccacggctgggggctcgaggaggcctgagcgccggccggcggacccgccccgggtgtcatgcccctgggcgacgctgcctgcgcccgtccgctacgtggccggctcgtacgctgccgactcggcggccaccctcaggtgttggagtgcgtacgagcgccaggggcgccaggtgtcggggacttcggcgcccggcggtgccacgtccgggtcgccgagggcacgggtacggatgacggcggccgtgtcgtcgtccatgcccggcagggcgagcagggtttgccgggcgtcgtcgcggtcggcgccggcgtcgaggcggagggtgccgtcggcgagggcggcggtcagggcaccgagtgtgccggccggttcggcctgtgcgagcacggccggttcggggaagacgtgggtgaggctgccgctgggggcgtcgagtgtcttcccgtaccgccgtaccagccgctcggcctccgccgtgcccaccagcgcgcgtacggccagctcgtccgggtcggccgtgcccggcgagcgcaggccgggacgggcggcgacgagcggaccgagccgggggtcctggcccaggcgttcgtcgacggcgtacggatcggcgtcgaggtcgaacagtcgccgcagccgctgaacggcggtggtgaggtcgcgcgggtcggtgaggcgcaggcgggcgtcgagccagccgccgtggtgggccggggtacggggcgcgggagcgccggggcgctcgtcgacggccacgattccggtgccgtacggaaggcggagggtccggcggtaggtgcgccggccgcgcggaccgttcatctcctcgatgcccggcacggtctcgcgggcgaggaggtcgaagacggcgatggcctggtacgggccccggtgggcgagccggagcgggatcccggcggagggggcggcgccgcggcgggcgggcggtccgccccggggcgcggcggcgcgcagctcactgggcgtggccgcgtacaccgccctgatggtgtcgttgaactgccgcacgctggcgaacccggccgcgaacgcgatctcggtgatggacaggccggtggtctgcaacaggacgcgcgcggtgtgggcgcgctgggcgcgggcgagggcgacgggtccggcgccgacctcggcggtgagttgccgctgcacctggcgggcgctgtacccgagccggacggcgaggccgccgacgccctctcggtcgacgacaccgtccccgatcatgcgcatggcgcggccgacgacatcggcccgtacgttccacgcggccgagccgggcacggcgtccgggcggcagcggcggcaggcccggaaacccgagctctgcgccgcggccgccgtggcgtagtaccgcacgttctgccgcttcggcgtcaccgccgggcagctggggcggcagtagatgccggtcgtctcgacggcgaagaagaactccccgtcgaagcgcgcatcgcgactgcgcaccgcctcgtacctggtctcttcatcgatcacgtcttccagtgtgcgcggtgccgcggcgcggggctggcgggaatcggacgtggtgtcggggcggggggtgcggacggacgaggccggtcaggccggtgcgggggccggatcacagcccccgcaccggtcacgccgggcaccgggcacaccgggcactggcaccgggcacccctacccccactgtccccgcttcgcttccatggccgccttcccctccgcccccttccgcttccagtcccggcggatctcggcccgcagccgggcgtcggtcttggcgacgatgcgctggttctcgcgcagcagcttgcgatagctgtcgaggcgccgctccggcagctcgccggtgtcgagggccgcgaggaccgcgcaacccggctccgcggtgtgcgcgcagtcgtggaagcggcattccgcggccagtgcctcgatctcggagaagacctggttgaccccggtctccgcgtcccagaggccgaccccgcgcagccccggggtgtcgatgaggacacccccgcccggcagggcgagcaggttgcgcgtggtcgtggtgtggcggcccttgccgtccacgtcccgcgtggcgtgcaccttcatgacgtcctcgccgagcagcgcgttggcgagggtcgacttgcccgcgccggactgcccgagcagcacggacgtaccgccggacaggaccgccgcgaggacgtcgagtccttcgccgaggttggagctgaccgacagcacgggcacaccgggcgccgccgtctccacgtcctgcacgagatacgagagcgtcgtcgcgtccggcaccaggtccgccttggtgaggaccaccaccggctgcgcgccggactcccacgccagggcgaggaagcgttcgacgcggccaaggtcgagttccacggcgagggacacggcgaccacggcgtagtcgacgttggccgcgaggatctgcccctcggagcgcttggaggaggtggagcggacgaaggcggagcggcgcggcagatacgtccgtacgtagcgggggtcgccggccggttcgacggcgacccagtcaccggtgcacacgacgcgcatcggatcgtgcggggtgacgaacgcggtgtcggcgcgcagcatcccgccgggggtgaccacgtcgcactgaccgcggtcgacccggatgacacgcccggccagcaggccttcggagtcgtacggggcgaactcggcctcccagtccgcatcccagccgtacggcacgagcggatgcgaggaagaggagaacgaacccgggagagaagagagtgacaaggggtgacccttcacaagggtggccccggcaccgcgctcactggcgcgggagatacagagaggtcagccggagaccacggaggtggacttgatgaacttccggatgcgggcagcgcccatcacagagacagccatcggtcacacctcccaaaccaagccaagtcaccagcggcaccacctggccgccgctcgaacatcaccgactctagaggtacgagggccacgacgccatcgatttacggcgcacctggcagtggctcgcggggagtcgggagtgtcctcgggacggcttgcacggcgtccggtgccgcaacacgcgggcacgggccgagcgttctcatccttccgcgtccggcgctccggctgatggagaagagacgcgggacggtactgacgtcggccgcgggcaggctgaccgctcctcggtcagctccagggcgactgcgccgggatcgcggtgccggcgtcggcgccacccactcgacaagcgggggcaagacgcggctgaaaagcgtcgaccgtggcgaaaggaggctctgcgtccaggagtgacgggtgttttcaggacagaactcgactgaacatatgcaccattggcggctttcgccttacgtttttgcccgatctggtcaatagttgtcgtgcggcacgtgttgaccgtagaaggatcacgtccctgcgcgggtgctatgaccgtgtgcccgctgactgcacaatcccttcgcgagtggacgtatccccgcatcccgcggacgtcgctccatcccgtggggggacccgtcatgaacagtgacaccggcagagccgacacgcccagatccggacaggcccgcctcggcggcctcgacggcgcccaacgacgggccggtcgcgtgctgtgctggacacacgccgttgccatgctgaccgccgccgcgcaagccgtcctgagccccgacttcccctggtgggaccgtctctggccgctgccctggtatctgattcccgccaccgggatcatctgggccgtcctgcgcgcccgctacaaacacgccctccaccagcagagcctcgaagaaggcatccccgccgacttcgatcggatcgcctgaaccccgaccgcggggtacggcctcagatcaacacgacgtggtcgtcccagccgttgcctgtcaccttctcgaaccacaggcgcgccgtgccctcggcgacggccgccggacacagcctccatcccgccccctcagcgatgctgacccgggtcgcgccacaggactccttgatgggactccatccgctgtcctcggcgtccccggtcatgacccgcacgccctcgggcccggccagcgccaccgtggggccaccccggtgtccgacggccgcgacatgggacaccgccgtaggcacgacacggcgctcccgtcgtcgacgagtacgacggtgctgccctccgtgtcccgggccgccgccaggacgcgtacggccaccgtctgctcgatccgctgccgcgcgggctcgccaccgtctgctcgatccgctgccgcgcgggctcgccaccgtccgccggtcaccgcaccgcgtacaacgcaccgtcgtgcgcggtccagccggtcaggtccccttcggcggacggcagactgcccagcaggcattcgacacgtcaacgaccgcgtccatatcaggcatggcggcagattaggcggcggcggtccggccgcggggcggaagtcccgaccgggcgcgggcccgaacacgccgaccgggcgcgaacggcgtggccgcgcccgggcggcggcttcggtcagccggtcgcggcgcgcctgccgcgccgccggaggccggtcgtcgtgcacttgccgccggtcagccggtcagccgttcgtcgtgcacttgccgccgttcagcgtgaagccgtacggggtcgtgttctcgtcgtgccaggtggacaggaagccgaaggcgaaggtgccgtcggccgcgacctgcttgttgtagtcggctgccgcggccgtgacccgggcgccgctctgggtgacgctcgcgtcccacatctggctgatctgctggccgtcacggaacgtccagccgatgcgccagttgtcgagcgccttttcggaggtgaccgtgaccgtggcctggaagccgtccggccattcgttgagtatctcgtacttcacctggcagtaggacggggccttcgtcgagccgcccgccttgtgcgtctcctccacggtggaggacgacttgccctggggctccgtgtcggggtcgctgctcttcacctcggacttcgcgcccgtcggccgcgaagtcgaggaggaggacgaggacgagggggcggcggccgaccccgagggcaggtccgcggcgggcagtgacgcagcctcgcccgccaccggccggccgtccgtcgcgtcgtcgctcgccgacgcgccgccgcccgagtcgccgaactgcatcagcgaggcccccagcgcaagcgccgacacgatcacggccgcggccaggatcccggtcctgccgatccgcggccgggccgtcccgccctgggcgagcccggtgtccgcgcccgtgtacacgcgcccgccactcagtcccgcgtccgccgcccggcgccggcgctccagataggcgagcccgccccagccgatgactccgcccgccagcgcggagggcagtcccccgccgtgcagacgcaggcacgccgcggcctcggcgcactccacacaggtggcgaggtgccgcgagaggtcatcgggcgcaccggcgttcggtgaccgggtcaccgcgtcgaggagccgcgcgtagctgcggcactcggccttcatgggggtgtcgaggtggttgcggtggcagcggtctctgaacagcgcccgtacctggacgagttcctcggccgccgccgtggggtcgaggccgagccgacgggccacgtccggcaggggcagcgactccacctcggccagccacagcagcgccgcgtccggctcctgcatgtccctcagaccgcgcagcgcgagcgggcggtgcaggggcggcccggtgtagcgtgcggccttgtcggagttgagccacagccgcaggtcggggtcgagacggtgcccctgcccgtgggcctcccaggcggcggcggcagtgcgaacggccgtcagcagcagcggaatgcgcggcagcctgagcgtccggcgcccggtgtccttcgccgtggcgtcggcggcgcgcgcctggtggatcccgtgcgtgaacgcctcggtggcaagctgtgccgcggcagccgaaccggacgtgcacagatcggcgtacgacaggaccgcgtcccagcactcggagaacagtgctgcctcggcggcgtcctggggggtcggcaggtcgggcatggggagctcctgcatcgagtgcatccacaagaagcgtcaactccccctcggtacaggggagttggggttgtctcacgacaggccccgagcctttcacgatttcagcacaactgacaagctgcgtattcaatttccgttaccggcggttacgcaactctcggtccacggcggccggttgcgaccggcggcgagcgttccggctgcgcggaccgcccggctccgggtgtcccgagtgtggtacggaaaggaggccgggacgtatcgattcccgtcgactttcaccggatcttccactccgtgacggccgcgagtgatcacatacacgcccacccccggctcgggcgcgcgccggagccgggggtgggccgggcggggaggggatcgggtagggaagctaccgagccgggagggggcctgccgccccgcgggtgagggctaggccggggtcggttcctgtgccgggaggctgtccatgaaggagctgacggagaagaccgcgcgtcccgggccgggctccccgtagccgggcggggaggagagaccgaagtcctccatcgtggcgcggtacgcctcgagcaggcggatgtggtactccagcggcgcaccctgcgggttggccttgccgagcggcgtcgtcggctccgggcaccaggtggtgaagcggggcgtgatgccgtgcgacatgaagaagcgcaggccctcggtggtggaggcgatggcctcgtcgaccgtcgtgaagccgaagggctccgccatctccacgcccgccacgaagttggggatcacattgcgcgcgccgaagatctccgccgagtcgagaatgcgcttgtgccactcgtcgcggccgacgtagcgctcctttccggggcagtacagctcgaacagccggcggtcccacacctcgtagttggggtggtagatctgcacgccgtggtccttgaagcgctggacgtcgtccctcgggagcgcctgcgcgacgaccttgccgatccagcgccccgggaagcgctcctcgatggccttggcgtagtgcccgtagaagtcggcctcgtcgcgcccggcgaccttggacgtgatcgcaccgcccgtgagcgtgtacgcggtggacgccttcgcggtgtcgtaccggtcgatgatctccagcgcttcgaggacctcctcgacgtccttcacgccggtgtacgggcggcccgccgccttgtgctggcgccagttgtggttgatgtcgcagtactggcactcctccttggcgccgaagtactggcagacccggaagacggtgaggtagatcagatagccccactggatcgtcggggcgacctccatgacggacttcccgttggagagctggtgccggtagtactccggcatcggggggacgccgacgtccgagatccgcttcccgtcgaggtagagcccgagcatgccgtcctcgtcggcggccacccggtacggcgaggccgggttcacgcgcaccgacacgacggtgcgccgcaggtcgtacgggccaccggtgaggatgatctcctccggcggccggcgcagcgcggcctcgcccagctcgggcagggtgccgtggtcgaaggagaagatgaagtacgacttcggcttgacgtcgccgtcctcgttgtccgagagcgccgagtcgtcgaaggccacacctccccggagcaggtcctccttgaaaacggcttcccgcggtacgtgcgggaaccgctccatcagatcctcgaccagcgcggtacggctgcccatcccgtcctccttgctcccgagtcgttcccggctcctgtgctcgactcctcacggtatgccccgtgcgggcgaccggccgtgccggggccccgaacaggcgctgaccgggctgcaccgcgggcggcccggtccacgcccggatgtgccgcgcgggcccatggggcagggtgcgccaaggggcggctcagccccgctggggccggtgcccgcggtcggtctccggggtcacgcggtgcgctccagcgcgccggggtcgatcgcgtacgccggcgcctcgccccctcgcagccgctccgcctcctccgtcacggtgaggccgaggcgggccacctcgttgccctgcgagcccgccaggtggggggtgacgaaggcgttcggcaggtcgaagagcggggagccggcgggcaacggctcgggttccgtgacgtcgaggacggcgctgagccgtccggcgcgcagttcgtcgacgagcgcctcgtggtcgaccagggcgccgcgcgcggtgttgacgaggaaggacccgtccggcatcagggcgagttcgcgacggccgatgagccgacgggtctcgggggtcagcggggcgtgcagggtgacgatgtcggaggagcgcagcaggtcgtccaacggcagcaggggaacgccgagccgggcggcctccgccgcgtctacgtacgggtcggccaggctcggccgcaggtcgaaggggcgcaacagttcgatgagccggcggccgatgcgggaggcgcccacgatcccgacccggcggccgaagttgccgacgcccggcaggatgtcccccatgggaaaggcccggtcggtgcggaagcggtcgcggtgcgcgaagaggtccttgccggcgagcaggatcatggcgagcgcgtattcggcgacgggcagcgcgttggcgccggccgcggaggagaccgcgatgccgcgttcccagagcgcgggggtggcgaagcccttcaccgagcccgccgcgtgcagcacggcgcgcagctcgggcgccgcgtcgaggacggccgcgtcgaggcgggggcagccccagccggtgatcaggatctccaccccggcgagcgcctcccgtacccggggagcggtgaagtcctcggccaccagaccggggtcgatgtccacacaggcgcgcagtcgggcgagcacctccggcgggaagatccatggcacgttctcggcggtcatggcgaacatcgccaggggacgctcgggcaaggaagtgaccttccggctggctggatcaggcgtagcaagcggtgtctacggtaggtgtcgacgaatgaaggggtcaatggaccggaacgcccccggcggaccggaaagtccccgtacagagaggccgggcagggatgactgacgcagggaccgcgctcaccaactgggccgggaacatcacgtactcggccaaggagctgcaccggccgcaatcgctggacgcgctgcgggcgctggtcgcggacagtgcgaaggtgcgggtactgggcagcgggcactcgttcaacgagatcgccgagccgggtgccgacggcgtactgctgtcgctgaccgccctgccgccgtcggtcgaggtggacacggccgcccgtaccgtacgggtcgcgggcggggtccggtacgccgaactcgcccgggtggtgcacggacacgggctcgcgctgcccaacatggcctcgctcccgcacatctccgtggcgggctcggtggccaccggcacgcatggctccggcgtcaccaacggctcgctcgcctcggccgtgcgggaggtggagctggtcacggccgacggttcggcggtgcggatcgggcggggcgacgaccggttcgacggcgccgtgaccgcgctcggggcgctcggggtggtcaccgcgctcacgctcgatctggagccggactaccgggtcgcccagcaggttttcaccgaactcccgctggcggggctggacttcgatgcggtggcggcttcggcgtacagcgtcagcctcttcaccggctggcggacgtcgggctttgcgcaggtgtggctcaagcgccgcaccgaccggccgtcggccgacttcccgtgggcggcgccggccaccgaggcgatgcaccccgtgccgggcatgcccgcggtcaactgcacccagcagttcggggtcccgggcccctggcacgagcgactcccgcacttccgggcggagttcacccccagcagcggcgccgagctccagtcggagtacctgctgccgcgcccgtacgccctcgacgcgctgcacgccctggacgccgtgcgggagacggtggcgccggtgctccagatctgcgaggtgcggacggtcgccgccgacgcgcagtggctgagccccgcctacgggcgggacaccgtggcgctgcacttcacctgggtcgaggacctggccgccgtactgcccgtggtgcggcgggtcgaggaggcgctggaccccttcgacccgcggccgcactggggcaaggtcttcgcggtcccggcgcgggtgctgcgcgggcggtatccgcgactgggcgatttccgggccctggtggactcgctcgatcccggcggaaagttcaccaacgccttcgtacgggaggtgctgggctccggcgaccggccgtcgtgagaagatcggcgaccgggaacggctgacacctcccggacttcctacaccccctttcctaaccccttgtcgaaagacccggcaggccatagcctggcgccgcgccggggccgacgggcctcgtcatggcctggagggatcgagggatcgtgtcggtgaagcgcacctcacgcgacatccgcaccgcgaaccgttacgaggtgctccgccagatcatcgccaagtcacccacctcgcggcaggaactggcggccgcgaccgggctcagtctcgccacggtcgccacgctcgtcggggagctgctcgacctcggcatgctgaccgaggtcggattcgaggactcggcgggcgggcggccacgcggtctggtcgccgtcaactccggcggcggcgcgctgatcggcgtcgacatcgcggagacgtacgtacgggtcgagctgttcgacctcggactgggccaactcgcccgcgccgacgaggacatgcgcccgggcgagagccgcccggagcaggtcgtcgggcatgtcgcggccgcggtcggctcggtcgtcgcgcaggccggggtggacggcgcgcgcgtcctcggcgtcggggtgagcgtgccgggccaggtggaccgcgaccgcgggatcgccgagtacgcgccgaactgggactggcacgacgtgccgctgctctccctgctcgccgaacacatcacccatcccctgtacctcgacaatccgctgcgcgcctgcgcggtggccgagctgtggttcggcgcggcccgcgggcgcggggacgccgtggtggtgaacctcggcaccggggtcggcgccgggctggcgctgggcggcgcgctgcaccgcggggtcagcaacagcgccggcgagtggggtcatacgacgctcgtgctggacgggcggctgtgccactgcggcaaccacgggtgcgtggagacgtatgtcggggcgcccgggatcatgcagaacctgcgggagctgagccccgccgaccccctgctgcaccccggggaccagaccgccacgatcgacgcgctggcccgtggggtcgccgcgcgggatcccgtggcgctcaaggtcgttcgcgacacggcccgttacctgggcgccgggatcgccgacctggtgaacctgctcaaccccgaggtggtcgtgctcagcagctgggtggcggccacgctcggcgagccgttgctcgacgaggtgcgcgaggccgtcgcccggcacgcgctgaggcgaccgttcgcctccaccgagatcgtcctctcccccatcccgaccgacccggtgtgcctgggagccgcgaccttcgccctcgaaggcgccctccagtcggtcgggcagcggcccgcgcagcgcgccacctccgcgaggagccgcaccgcaccaccgtcatgacgacgcccctcgcctgacccgcgagcgtcccgcccgacagagggggcggtccggtcgtgcggcggcccaccctcgtcacgtccggtattccgaacgctgcacaacacttcgaacagccttcgtccaaccccttgccgaagccttgaccgaaggttagcgtccggctccgcgacgccagatcgagccactgacgcacagcagttgagccgcagccgtactcaagacaaggacgtcaccatgtcggcaacgagcaacagcaactgggaccgccgatccgtactccgagccgccgcgggcctcgcggcgctgggcccgctggccgcctgcggcagcaacaccggccgttcgggcggcgggagttcgggcgagagcctggtgcagtacttccacgcgtacggcgaggcgggcaccgagcaggccatcagacggtacgcgaaggcgtacgacaaggccgccgtgaccacgcagtggatcaccggcaccaacttcgagagcaagctgttctcggcgctgctcaccgacaacgcgccggacgtcttcgagttccacccacagctccagatgatcaagagcggccaggtggcggcgctggacgacatcatcgatccggtcaaggacgacttcaacccggccgacatcacgtcgcacacggtcgacggcaaggtctacggcgtccggatgatcgacgacccgcagttcttcttctaccgcaagtcgctgctggaaaaggccggcacgggcgtcccccagaccctggacgaactcgccgaggccgccgccaaactcaccaccgacaaggtcaagggcctgttcctcggcaacaacatggtggcgccgaactacgccctggtctgggcggccggcgccgatcagctcaacgccaagaacgagatcgcgtaccacaccgacgaggtggccgcggcgctgaaggtgtaccgcaagatgttcaccagcgggcatctgctcctggacgcccccgccgactactgggacccctcggctctggtccagggactcaccgcgatccagtggtgcggcatgtgggccatgcccgtgatgcagcaggccctcggcgacgacctcggcatcttccccttcccctcggcggcctccggcgccaagcccgcggtctacaacggcggctggtccatgttcgtcaacgccaagggcaagaacgtcgacctggccaaggagtacgtgaagtggctctggatcgaccagaagaagtaccaggaggactgggcgctcagctacggcttccacataccgccgcgcacctcgaccgccgagtcggccaccaagctcaagtcgggcctgcccgctgagggcgtcaagctcttcaccgactacgggcgcttcgacaacgtctcctggacccaggccatgatcagcgcgctcgagggcgtgatcgccgacgccgtccgcaagggcaaggaccccgaggccgcgctcgacacggcggacaagaaggtcaaccgcgagctcaagaatctcttcggataggccggcggacaggtaacgacaggcggacaggcaacgacatgtcgaccaccacgacgcgtgacgtcgcgcgccccgccccggccaaggcgtccaaggccgggccgcggcggggtctgcggggcaccacgctcaacttctggctcttcaccggaccgttcctcctcggcctggtgatcttcgtctacgtccccatcggctggagcgtctggctcagcttcttcgaggcgcgctacaccgtcacgcccagcaagttcatcggcctcgacaactaccggcagatgctgacgaacggcgccttcgtcgacgcactggtcacgttcaccgtcttcgccgcgatcatcgtgcccgtcacctgggcgctgtcgctcggcctcgcgctgatggtgcaccggctgcgcttcatgaaggcgttcttccggtcggtgttcttcctgcccaccgcgtgcagcttcgtcgccgcctcgctgatctggaagatgtccatcttcagcggggtgcgcttcggcctggcgaacaccgtcctcggctggttcggcgtcgagaacatcgcctggctggccgaccccgacccgccctggtactggctggtcatcgtcacggtacgcctgtggctccaggccggtttctacatgatcctgttcctggcggccctgcagaacatcccgccggagctgtacgaggccgccgccatcgacggcgccgagccgggctggcagaccttccggcacatcacgctgccccagctgagggccacgtcaactgccgtgatcctgctgctccttgtggccgcctaccaggccttcgacgagttcttcaacctgctgtcgaagaccacatggggccggccaccgctggtcgagctctactacacggccctgggcgaaaaccaggactacggcgcgggcagcgcgggcgcggtcgtcctgaccctgctcatctgcgtcgtgacgctgctccagggcaggctcatgggtttcggacggggggacgagtccaagtgacgaccgtcatcgagagcgacaaggccggcgccgtgcccccgaagaagcgcgggcgcgagggacggggcgtcctcggctccaccggcctctacctcgccaccggcctctgcgccctgctcttcctggtccccttctacctgatcatccgcaacgccctgtccacggacgccgaaatcaccggcgaggaatggcagttcttccccacgcacatccggtggggcaacatcaccgagctgttcgacgacccgaccgtgcccttcgcccgttccctgtggaactccgcggtggtcggtgtcctccacacggccggcaccctgctggtctgctccctcgcgggctacggcctcgccaggatcccgtacaagcacgccgacaagatcttctacgcggtcctggtgaccctgatggtcccggccgccgtcaccttcgtaccgagcttcgtgctggtctcgtcgctcggctgggtggacagctaccgcggtctcatcatcccgggtctgttcagtggtttcacctgcttcctgttccggcagtacttcctggggttccccaaggagctggaggaagcggcgcgcatggacgggctcggctactggggcgcgtactggcgcatcgtcgtgcccaactcgctgaacttcttcgcggccatggccaccatcaccttcatcagcggctggaacgcctttctgtggccgctggtcatcggccagggcgaggactcgtggaccgtgcaggtcgccctctcctcgtacatgaccaaccagaccgtcaacttccatctgatcttcatggccaccgccatctcgatcctgcccctggtactcgtgttcctcttcctccagcgctggctggtgcagggggtcgcgcagaccggcatcaagggctgacaccgccttctcaagacctggagaccgatgtccttccgcaccaccgcttcgcccacgtccaccgagtacgtcgaggacgtctcgccgggaagcggggcgctgcccccgagggcctggtacgcatcctcggacgccgtgtccctgtcactgaacggcagctgggccttccggctgtcgccgaccgccgacgcccaggacgactccttcgccgcggaggggtacgccatcgaggaggagggggaggggtacgacgccggggactggaccgagatcgaggtccccggccactgggggctgcaaggccacggcgcgccgatctacaccaaccacctctacccgttcccggtcgacccgccgcgcgtgccgaccgagaacccgaccggtgaccatctgcgggtcttcgatctgccggccgactggcccgcactgtcggacggcggctgcgtgctgcgcttcgacggcgtcgagtcctgcgcccgggtgtggctgaacgggacggacatcggggagttcaagggctcgcggctgccgcacgagttcgcggtcggacacctgctgaagccgcgcggcaacgtgctggccgtgcgggtccaccagtggtcggcgggctcgtacctggaggaccaggaccagtggtggctgcccggcatcttccgggacgtcacgctcctgcaccggccggcgggcagcgccctcgacttcttcgtgcacgcctcgtacgagcatgtcgaggggctcggcaccctgcgcgtcgactccgacgtcgacggccgggtcaccgtgcccgagctggacgtcgatgtcgagaccggcgagtcggtgacggtcgccgtcgagccgtggaccgcggagacgccccggctgtacgacggcgtgctggccaccgagggcgaacaggtccccctgcgcattggcttccgaacggtcgtacgccaagacggtctgatcaaggtcaacggcacgcccgtcctcttcaagggcgtcaaccggcacgaatggcaccccgagcgcggccgcgccctcgacctggagaccatgcgccaagacgtgctgctgatgaaacggcacaacatcaacgccgtccgcacctcgcactacccgccgcaccccgccttcctcgacctgtgcgacgagtacggcctgtgggtcatcgacgagtgcgatctggagacccacggcttcaccgagcaggcctggcgcgacaacccggtcgacgacgatcgctggacccccgccctgctcgaccgcgcggcccgcatggtcgagcgggacaagaaccacccctcggtcgtcatctggtccctcggcaacgaagccggcaccggacgcgggctcaccgccatggcggagtggatccgcggccgggacacctcgcgtctgatccactacgagggtgacatcgactgccgtgacacggacgtgtattcacggatgtacgccgcccacgccgaggtcgagcggatcggccggggcctggacgggggcacgcaccggcggcgcgacctccccttcgtcctctgcgagtacgggcatgccatgggcaacggtcccggcggcctcgccgactaccaacggctcttcgagacgtacggccggctccagggcggcttcatctgggagtggatcgaccacggcatcaaggacgagcggtacggcttcgcgtacggcggcgacttcggggaggagctgcacgacgggaacttcgtctgcgacgggctgctgttcccggaccggacgccgtcgcccggcctggtcgagtacaagaaggtgatcgaaccggttcgcatcgagggatgggggtcccccctggccgggcgaagccgagcgcccgggggaggtgcggacggcacggacggcacggacggcacggacggcacggacggcacggacggcacgatccgtgtgacgaacgcgtacgacttcgcggacctttcggcgctggccttcgagtggtcgtaccaggtcgacggagagaccgtcgaggcgggcgcgctgtcggtgcccgcgctcgctcctggcgagtcggcggacgtgaagctgccgacgccgcccgtggacgggcggggggccgagacacagtggacggtacgcgcggtgctgaccgccgagaccgcgtggggcccgaaggggcatcaggtggcctgggcccaattccctctcggcaaggggagttcggagcgtgtcgcccggcccggcggtcgggtcgccccgtcctgcggtccggtgcccggcgagcgccggatcaccctcggcccggccgccttcgacgcccgcacgggtgcgccgcgaacgatcggcggggtcgacgtcaccgggctccgcctggacgtgtggcgcgccccgaccgacaacgacaacggcgcgcactggcagccggacgagcgctacggcccgctctggcgcaggctgggcctgcaccggatgcaacaccgcctggaggcggtggagttggacgacgacgccctgaccgtacggtcccgggtggcgcccgcgggctgggaggtgggcctgcggacggcgtaccggtggacgtccgacgggacgcggctgaggctgacggtgtccgtggcgccggagggcgactggacgctcccgctgcccaggctcggcgtgcggttcgggctgtcctcggcggcggaccgggtgcggtggttcgggggcggccccggcgaggcgtaccccgacaccaggtcggcgtccatgctgggccgttgggagtcggccgtggacgacctccagaccccgtacgtccggccgcaggagaacggggcgcgcgccgacgtccgctgggcggagatcggcgggctgcggatcgagggcgagccggagttctggttcacggcacgccgctggacgaccgagcagctggacgcggccgagcacctcacggacctgacgcccggtgacaccgtgtgggtcaacctcgaccacggccagcagggcatcggctcgcagtcgtgcgggccgggcgcgctgccgcagtaccaccttcgtccgggcccggcggagttctccttcgtcttctcggaggcgtcttctcggaggtccatgtctgaaccgcgctcgcgacgctgatcgcggcaggcctgtgcgcggcgctcctggcggggcgggtgcgggcgccccgcccatcaccgggagcggcaacctgcccgcgcccggcggcaactcaagggggacgcaccacgcccgcatccgcccccactcccaggagcagccgtgccccacacaacagccgcccaccgtcgtcgcgcctcccgtcccctccccctcgtagccgtcggcgcgctggtcgccgccgccgtcgccctcccccagctcaccccggacgcctttgccgccaccaccctccggggctacgccgacggccgcggcgtgcggatcggtgcggccgtcggcgacagcccgttgcggagcgactcggcgtacaccaccgcgctggaccgggagttcaactccgtcaccgccgagaacgcgatgaagtgggacgcggtggagcccagccggggcggcttcgactgggccgccgccgaccggctcgtcgcgcacgcgagcgcacacggccagggagtacgcgggcacaccctggcctggtacgcacagctgccgtcgtggctgaagaacggcaacttctcggcctccgagctgaacacgatcctcaagagccacatcgacaccgaggtcggccgctacaagggcaaggtgtacgcctgggacgtggtcaacgagacgttcaacgaggacggctcgatgcgcggttcgctgtggcaggacaagctcgggaccgggtacatcgcgaacgcgctgcggtgggcgcacgccgccgaccccgccgccaagctgtacatcaacgactacaacatcgaggcggacaacgcgaagagcgacgccctgtacgcgctggcgaagcaactcctggcggacggggtgccgttgcacggcatagggttccagtcccacttcgtggtcgggcaggtgccgtccaccatgaaggccaatctcaagcgcttctcggacctggggctcgaggtctccgtcaccgaactcgacatccgcatccccctgcccgcctcctccgacgaactggctcagcagtccgccgactacaagacggccagcgagaactgcctgggtgtcgcgcgctgcgcgggcatcaccgtgtggggcgtcagcgacaagtactcatggatcccggggacgttcagcgggtacggcgcggccctcccgtacaacgagagctacgcggcgaagcccgcctacaccgggctgtcgaacggactcgatccgaccgcgtgagccgcgtcccgccctggcccggcagggacggtccccggtcggatcgcccctgccccgggtcgcgctggacgcgtcgagaccagggcctcggtcaggtgccgacgtaggccgcgaggtgctcgccggtgagggtggagcgggcggcgacgaggtcggcgggtgtgccctcgaagacgatccggccgccgtcgtggcccgcgccggggccgaggtcgatgatccagtcggcgtgcgccatgaccgcctggtggtgctcgatgacgatgaccgacttgccggagtcgacgagccggtcgagcaggccgagcagctgctcgacgtcggcgaggtgcaggccggtggtcggctcgtcgagtacgtagacaccgcccttctcggccatgtgagtggccagcttgaggcgctgccgctcgccgcctgacagcgtggtgagcggctgaccgatggtgaggtagccgagcccgacgtcggcgagccggccgaggatgcggtgcgcggccggcgtgtgcgcctcgccggcgccgaagaactcctcggcctcggtcaccgacatcgcgagcacctcgctgatgtcgcggccgccgaggtggtggtcgaggaccgccgcctggaaccgcttcccctcgcactcctcgcaggtgctggcgacgccggccatcatcgccaggtcggtgtagatgacgcccgcgccgttgcaggtggggcaggcgccctcggagttggcgctgaacagcgccggcttcacgccgttggccttcgcgaacgccttgcggatcgggtcgagcagtccggtgtacgtcgccgggttgctccgcctggagccgcggatcgcgctctggtcgaccgacaccacgccctcgccggccgggatcgacccatgcacgagcgagctcttgccggagccggcgacgccggtgacgacggcgagcacgccgagcgggatgtcgacgtcgacacccttcaggttgttcgccgtcgcgccgcggatctccagcgcgccggtgggcttgcgtaccgtctccttgacggcggcccggtcgtcgaagtggcggccggtgacggtcccgccggcccgcagcccctcgacggtgccctcgaagcagacggtgccgcccgccgtgccggcgcctgggccgaggtcgacgacgtggtcggcgatcgcgatcgtctccggcttgtgctccacgacgagcaccgtgttgcccttgtcccgcagccgcagcagcaggtcgttcatccgctggatgtcgtgggggtgcaggcccgcggtgggctcgtcgaagacgtaggtcgtgtcggtgagcgaggagccgaggtggcggatcatcttgacgcgctgcgcctcgccgcccgacagcgtgcccgccggccggtcgagcgagaggtagccgaggccgatctccacgaacgagtcgagggtccccagcagcgcgccgagcagcggcgcaaccgacggctcgtcgaggccgcgggcccagtcggccaggtcgctgatctgcgtcgcgcaggcgtcggcgatgctgagcccctcgatcttcgacgaccgggccccctcgctgagccgggtgccgtcgcactcggggcagacggtgaacgtcatcgcgcgctccacgaacgcgcggacgtgcggttgcagcgcgtcgatgtccttggacagcatcgacttctggatcttcgggatcagaccctcgtacgtcaggttgatgccatcgaccttgatcttggtcggctccttgtggaggaggtcgtgcagttccttcttggtgaacttgcggatcggcttgtccgggtcgaagaagccgcagccgccgaagatgcggccgtaccagccgtccatgctgtagccggggatcgtgagcgcgccctcgttgagcgacttggagtcgtcgtagagctgggtgaggtcgatgtcggagaccgtgccccggccttcgcagcgcggacacatgccgccggtgcggttgaaggtggccttcaccgccttcttggcaccgcgctcgacggtgatcgcgccgctcgcgcggaccgaggggacgttgaaggcgtacgcgctgggcgggccgacgtgcggctgcccgagccggctgaagaggatgcgcagcatcgcgttggtgtcggtggcggtgccgaccgtggagcgggggtcggctcccatccgctgctggtcgacgaggatcgcggtcgtcagcccctcgagcacgtcgacctcgggccgcgccagcgtcggcatgaagccctgcacgaaggcactgtaggtctcgttgatcagccgctgcgactccgcggcgatcgtgccgaacaccagcgagctcttgcccgagccggagacaccggtgaacaccgtcagccggcgcttcgggatctcgatgctgacgtccttgaggttgttcacgcgcgctccgtgcacgcggatcagatcgtggctgtcggcgacgtgcagcacgggcgcctgcgtgtccgtcctcgtggccatgctcatcgtgtctccatctgttgggcgggcccgccttcgcggtctccgtcggcgccgcctcgctcgatccgaccggcctcgagcgtacgtccggttctgctgcgcacggcgctcacgctagccgcggccagggggcccgcgcttctcgaatcctgatcggtccggccgccgccgtcgcatcaggtccgacggctcgatgtcgcggcgcacgatgttccgccgcgcgtctgggtatattaggcagctacctagaggccctaggctgttgggtgactagggggctgagggccttgatggctgaatcaggtggaggtggtggctcatggctcgtgtcgggctgacggtcgatcgagtcgtggaggccgcggccgacctcgcggacgaggtcggcttcgagaacgtcaccgtgtccgcgctggcacggcagttcggggtgaaggacgcgagcctgtactcgcacgtcaagaacgtgcaggatctgcgcacacgggtcgccctgctggccggcgaggagatgatcgaccggatcgccgccgcggtggccggccgctcgggcaaggacgccctggccgccttcgccgacgcctaccgggagtacgccctggaacggccgggacggtacgcggcgacccagatccggatcgaccagaccctcgtcgcctcctcccgcgccttccaccggaccgccgagatcacctacggcatgctgcgcgcctacggcctcgaagagcccgacctgaccgacgccgtacgactgctgcgcagcaccttccacggctactgcgccctggaggcggccggcggattcggtgcgccccgtgacgtactggcgtcctggcagcggaccatcgacgccctccacgcactcctcgaacactggcccgaacaggagagggaccgtgactgacctgtactacgaggtgtgcggcggcgggcccgtgctgctcgtcgtccccggcggggccgggcatccgatggggctcgacgggatgacggagcgcctcgccacgcggttcaccgtcgtcacgtacgacccgctcggcctcgcgcacggacggctcggcgaacccgtcgaggaccagcgggcccaggcgtggagcgagggcgcgcgccgggtgctcgacgcggtcctgccggacggcgagtcggcgtacgtcttcggcagcagctcgggcgccatcgccgcactggacctgctcgcccgccacccgcggcggctgcggcacgtggtcgcgcacgagccgccggtggtggcggtgctcgacgacgcggccgcgcaacgggcgatgttcgcggaggtgtacgaggtctaccgggcggcgggcctggaggcggccgcggcccgactgggcgccgggctgacgggaacgactcccggcgaaccgcccggcggcgccgcccaacccccctcccccgccgacgagttgtcccaccccatgccgctcttcctcacgcgcgtcctgcgtcagttcaccgcctacgagcccgacgtgaccgcactcaccgccctgtccccgcgcctcaccctcggcgccggcgccgactcgcgcggccaattgctgcaccgcacggcctccttggccgccgagctgagcggcagcggtttcgtcgagttccccggcggtcacgtcggggcggtcgaacaccccgtggagttcgcggaccagctcgcggagacactgcttccggccggtgccccaggcgtaccgctgaccacttagactgaaagcttcgccggtagcacgtgccgccctgggggagggagcgcgccttgtctcaacaacagctgagacgcggaccgtcgaggtccgacccggcgccggtcacgcccggcggttcgcgaccctcgaggttcgtgggctggctcggtggcctcggctgcgcggccgccgggtacggagtgttccagttcctgttcggagtgctgcccgacagcgtcaccggcacccccgccaagtatgtgatcgccggcgtcagcgggctcggcacggccgccgcggcctggctggcggcggcgctggtccgggcccgggccaccgcgtcggcccccggccccgcgccgatcccgtccaccaccgcgcccggcccgctcccccagatcttcacgggcgcctacgacaccctcgccgatcaggtcaccgtggtcgacgacccggtgcgcgggcagctcaccggctggtcccactccctcggcgaggccacgcccgtgcgcccgaccccggtcggcaccgcctacgggctgcacatcatgctcgacctgggcgtgcccgacgggcggctcagcaccggcgacctggtcgacaccctgtggcggctgcggttgccggacggcggctggtcggcgcggtcccaggggaccgcggcccggccggaggtcaccgccctggtgctgggcgcgctggcccgggccggcgccccgcgggaccggctggcggccgaggtggcgttgtgcgaggccgggttcacgcccgaactcgaccgtacgggacgcgagttgacccatgtggtgacgaccgtgctgcgcggactgctgcgcgcggcgccccgctccgccgccctccccctgctgcgcgaggccctcgtcggcggtgcgatcaccgacccgcagcgcgaccaccgccgctgctggagccaccgcctggtgccggtgcacggtcggccgtcgtcgctgcacaccgcgcaggccgtggtcgccctcgaccgcgccgcccgtgtgctgggcgagagcgcgaacgcgcgcgcggcccgcgaggacggcgtgcgctggctgctggcctgcgcggacgagccgcacgacacctgcctggacctggagaacctccgggaggaggtacggcgcccgcgcgcagacgacccctcgcgccacgaggtgctgaacgtacggcacttcaccgcctcctggatcgtgcgcgccctgctcaccccgggcgcgcgcgagctcgcccgcgaggacgggatcgaggaggcgtggcgggagcggctggacggcgcggtcacagccgtgtgggcgggacagaccgacggcatctgggcctgggtgcgcgacgacagcagcgagctgcgccggcccatgtggatgacctatcaaggcctttcggcgctgcgggcgcatgccgtatggatgtatcagcctggaagctgaagtcggtggcgtcaacgggttgttggagggtgagtgcatgggtggtcggcaggtcctggcggcgcggcggcggctcgcgcaggcgctggacggcgaacggcccgagcacgagctggtggcggccgcccgtaccgtcgtcgccgaactgggctcgacggagcgactgttggagctgatctccgaactggcctgcggcgagggggaccccgagggctgcgcccggctgtcgtaccggcacgttctcggcttcgacaagctcctgctgatcgacggcggtccacggcacatgctgcgcgcccatctgtggcaccccggcgcgggtgcgatcggcaaggaggacatccacaaccaccgctccccgctggcgtcctacgtggtccggggccggctgaccatggagttgtacgagcaggacgagcggaacgggcaggacgagcggaacgggaagggcgagcctcgcggcggcggcgggatggcggcggcccgctacagggagtccctggcggaccggtcggccgactggctgctggagcccgcgggcccggcccggctgcggatgacacacgtgggtcagtacacggcgggcagcgcctacgccctgcccgcgcacaccctgcaccgcgcctggtgcgacacggacgtaccgacggtgacgctcttcctggagacggggagtgaacggcggcgccacaccgatgtgttcacggcggccggcccccatccgggaacggtcccgaaggtgccgctcgacgtggcgggctacctggcggaactgggcggcctggcggagctgctcaggagttcgtgagggcctggcgcacgatgtccaggttgtactcgtcgatgtcgacgctcgacagctccgacggtgtcagccacgcgtacgcctggtcgggcgcggggagcgtgatgtccgtggacagcggccggaccaggaagttgtcctgccagttcttggtctcgtgcccccgatagtcgctgacgaaggacgactcgccgaccttgcggaccacctcgccgcggagtccggtctcttccttcagctcacgcagggcgccgtcccggggactttcgtccggttcgagcttcccgcacgggacgccccacacgcggggcaggaaccgttccctctcactgcggcgcaccaggagcacgcgcccctcgtcatccatcacgacggcggccgccagtcgtttgtcgccggggatgtccatgtccatggttcctcggtccctcgccggtgatgagtccaaagggtctgatacccacgaaagcttcaaccgtatcaggctaggcgtccgggccttccgcgctgagcgcctgaatctcggtgtacgtcggcgcgacgccccgcggcggtcgtcccgcccgaatgtccgcggcggcgtcaagggccgcgcccagcgcccgccggtacagcagggagccgaggctcacccttcgtacgccgaggtccccgagttgggcgacggtggggcccaggggtgagtagaggatgttgagcggcacgtcgagggtcttcaccagggcggtgatgcgggtcgggtcgctcagcccggggacgaacacgccgtccgcgccggcctgtcggtaggcgtcgaggcggcggcaggtctcggcgtggccgccgtcgccgagccagtacgtgtcggtgcgggcgttcacgaagaggtccggtacggcggccttgaccgcggcgatcttcgccgcgtgcagcttcgcggacgcgaggccgtcctccagattgatgccgacggccccggccgccgccagctcgcgcgccaactcggccacgccgtccgggtcgtggccgaacccgtcctcggcgtcgaccgagagcaggaaggtgcccccgccgagctgccgggcgagccgtaccgtctcttcccgggtcgccgccgtgccgtccggcagaccggccgccgcggcgacgccgaggctggtggtaccgaccgcctcgaaaccctgggccgcgagggccgccgccgaggcgtggtcccaggcgttggggagcagcaggggcgcgtcggcgtgatggagtgcggagaacgaggtcacgtccgcctgccgggtcacgccgacctgcccacggcgtcggcgtagtacgtcgattcctcgaggtgctcggccagtcggcggaagctccagccctgcgccggagagtcgtcgagctgcccttcggtcagtgtgccgagccggttcgcccagatccgggcgagccgcgtgagtcggctgcgtgcctcgtcgagatcctcgggcgtgaacggcgcgagatccgcctccgtcgtgctcgccgacgcgtgccagtggtcgggctgcggctcctcgcccacgagccgggcctccagctcggccaggtggtcgaggatcggggtatcccctgctcgaacggagttgagagcttggggaaggtcggtgacgcggcggatcgccttgtgcggggtgtagacgcggtcgtcgacgtgggcgggcttcccgtcccaggcggtccaggtcgcggcgaggtcgaggacgtggtccaccatggcgacgacggccgcggccgggttttcggtgccggtttccctcaggcgttcctgcgcggaatcgttcataccggaacgctagacgcggaacgcttcggcgcccgccgaaccatccccgcggcgtgcgcgcccgtcaccccgtcctacgccggcgcgcgcttaccggcgcctcgccggccacgacgacgctggggatcgggcgcctcacgccgacggcgtagccccgcggcgccgctttttgccgaagtggcaacacctctcgtgtccgccgcgtcgcccgacgcatgatctcggtcgtagctgattgccgaacgaccgggaggatccatgccgcagaccccgcggaccacagcgctcacccaccgtctggtgtcctcacccgcgggacggatccacctcgtggagcagggcaccgggccgctggtcctgctggtgcacggcttcccggagtcctggtactcctggcggcaccaactgcccgcgttggcggcggccggctaccgcgcggtcgccgtcgacgtgcgcggctacggccgctcctcccggccaaacgcggtgcacgcgtaccggatgctcgacctggtcgaggacaacgtggccgtggtgcacgccctcggtgagcggaccgccgtgatcgtcggccacgactgggggtcgaacatcgccgccacctcggccctggtacggcccgacgtgttccgcgcggtggggctgctgagcgtgccctacaccccgcgcggcggcccccggcccagcgagatcttcgcggggatgggcggggacgaggagttctacgtctcctacttccaggagcccggccgggcggaggccgagatcgaaccggacgtccgcggctggctcgcgggcttctacgccgccctgtcggcggacaccatgcccgcgcccgacgcgccggatccgcacttcgtacgccgtggcggaacgctgcgcgagcggttccccgccggccggctgcccgcctggctgagcgaggccgacctcgacgtctacgccggcgagttcgaacggaccggcctgagcggggcgttgaaccgctaccgcgccatggaccgggactgggaggacctcgctcccttcgacggggctcccgtccgtcagccgtccctcttcatcggcggtggtctggacgcctccacccagtggcttgccgatgcgatcgaggcctacccggtcacgctgcccggcctggtctcctcgcacatcctcgacggctgcggccactggctccagcaggaacgcccgcaggacaccaaccggctgctgacggactggctcgcctcactgcccggctgacacggccacctcgccgtcgcccagccggatccgtacctccgggccgtccgtccagctcacccggatctctcccgggtccgccacccgcacggacaccgcctcggcgaggggcacggggtcctgttccgccgtgagacgggccagggccgtgaacagtgtcggtccgtccgccgtcacgcccgtgaggtccccggagaggttgtggccgggcaggagttcggcgccgaggccctgcgccggcgtccagcccgtgacccgcaccggcgtcccgggcgcggcgcccgccaccaggtgggcgcgcacctccaccgcaccacgggccacgaccagactcgtgacccggacaccctcgccggccgtgtggcgggaggccgcccagccctcgcccacgccgagcggctcgatcgacgtacggctcggatcgccgcccacggtcacggtgttgtcgtacgccggcgaaggaaccgtcaccgtcgagtacgcgagccgggagtagtgggggtcgtagcggacgtcctcgctgccgtggttgtggaggcgcaccaccccgtccgaacgcgtgcactggagcagccagttgggggcggcgatcggcgtgacggcgtcggcgcgttccgccggacccggttcctccggtgccgtccacacctcgtggtcggcggggagcagcaggcccaggaacgccttgctcgcccagtacggggacgccgggcccgaatagccctgcaagacagccgagtcggggccgtgccagcccagggtcagcaggccccggtcgtccaccgcgccccggtcgaggaagtaccgcagcgcgccggatgccagcctgcgcgtctcgccgggcggcaggggcgtacggccggtcagcgcgcccagccacagcggggccgtcgtggcgaagcggtacgtcagggaccggccctggtgcaggggggctccgtccgcgccgaacaggcgtgcgtagtcggtgagatgggccgagagccggccgccgtacaggtccagcagccgcgcgtcgtcggccagccacgcgtgcaggacggggtacaggtgcatggcccagccgttgtagtagtcgaaggcccggccgtcgccgtcggtgtaccagccgtccccgacgtaccactgctcgatgcgctccagaccccggtcgacggcctcccgtgcgtcgtccggctcgtacccgatctcctggaggaagccgccgaccgtcaccgggaacaactcccagttgcagggccagggttcggcggtcagcgcgtcgccgagccaggccgccgcgcgctgtcgcaccccgtcggagaggcggtcccagagcaggggccgggtcaggcgcagggcgagggcgacggacgccgcctcgacgaggggctggccgcggtgctcgatgcgcggccagacgcccgagacgccggccgcgagtccgtccgcgtaccgctccagggccttctcgtcccggcggaaggcggccagcagcagcgtacgagcgtagccctccaggccgtcggagagcctgccggaccagctcgggcggtcgccgggcaggtggtagagcgcctggtcctcggtcgcgtacggggccacggcggcgagcagcgcgtcggcggtcgcctcccagtgggcgcgggtgtggccggtgtacgggctgagggtgcggtcctcgggcggcgtggcgggcgacctgaacggctgcatggcttcctgtctcgcgtcgctcggctgcgaaaggagcctggggcgccccggttccggtcgggacgccccaggggttcgggcggagggctgcctccgagggggctacctcgcctgcttctccgggatcagatgctgcgccaccaactcgtcgcgcaccagacccgcgtacagggtcgccccctgcactgaagtatgcgtgttgtcccgcttctcgttgtagagatagatcgattttgatctttccacacccagggattccacgagtgccttggtcttcgccgtcaggtcgatcaggggcacgtcctcggccgccgcgaccgagcggatgaccgccgggtggtccacaccgaggccgttgaccagcagcgcggtgttgttgttcagggtgccgtcggcgttgaaccagcggcgcacgatgggcgtgaccaggaccggatcgccgcccttcgcgcggacgcccgcgacgagcgtctcgaggttcgcgcggtacgtcgcctcgtccgtcgtcttgtcgttgtgggcgagctggatgaggaccaggtcgtgcctgcggatgagcggctggacggtcgggaagagcgcggggtcggcgaggtaggtgaccgtactctcgccggagtccgcgtagttggcgacggacagccccttgcggaggtactgcggcagctgttgcccccagccggagtaggggtcgccgggctggtcgcagaccgtggagtcgccgaccaggaagatctgccgcgggtgccgcgcgggcgtgacgctgataccggccagggcgggggccgcgccgccgagcaccaggtcgaggccgggcgtgccgtcggcgccggtgggctcgccctccggcgtgcggacgttcaccgtgaagccgcgggccacgcgctcgcccgcctccgtggccgtctcgggcagcagggagcgccgcgcctcaccgctgatgctcgtaccggccgccgcgtcgccgccgagcagcacgcggacgtcgtacgtcccgggcgcgacgtcgaagtgacaggcgctggcggtgcagttctccaggcccggggcgcgccgcccctcgtgcgcctgcgcctgggccggcaccgccgacagggcggtgacggcggccagcaccgccggcacggcggtggtgaaacgtctcattgcggctcctccgacaggacgacagacctgacggctggaccgtaccgctagcggcaagcgctttctagtagagggctcaatttcacatcaccgtcaactccccgcgcgtgaaaggcctttcgcgaaatcgattcaactgccaccctgccagacacccgcacccccacacctcccgaaggaggcacccccgcatgtccggttcccccaacaggccggtccgccgccgcaccttcgtactcggcggcgcggccgccgccggcacggcggccctcgccggaccgctcgcgccccccgcgtccgccgcgggcttcggctacacggacgacggctcgaactacgtcgtcgacaccggcgcgaacctcgtcttcaaggtcagcaagaccaacggcgacctgacctcgctcgtctaccgcggcaccgagtaccagggctacggcggcaagaactcgcacgtcgagtccggcctcggcacctccgccgtgacgatcgcgcagtccggttcgacgatcctggtcagcgtcacgtacgggacgctcaagcactactacgcggcccgcagcggcgagaacaacgtctacgtgtggaccaacaaggcggacacgtcggtcagcgcgacccgctacatcgtgcgcgtcaaggcgggtctgttcctcaacgacgagcccgattcctacacgtacgcgccgaccaccgtcgaagccgcggacgtgttcgcgaaggcggacggccagacccgttcgaagcactactcgaagctccgcgtcgtcgactacgactacatcggctggagcaccggcgccgtcggcttatggatggtgcgcagcaaccacgagaaggcctccggcggccccttctaccgctccctgctgcggcaccagagcgcggacggcggcggcctgtacgagatcctctactacggcgagaaccagacggaggcgcagcggttcgggctccagggcccgtacgtcatcgcgttcacggacggcggcgccccctcgtcgtcgctgtaccccggaaacctcacgacctcgtgggcggactcgctcggcatcttcgggtacgtcgccgccgggggccgcggcaaggtcgcgggcgtcggcatctcgggccggaacacggcgtacgcgtacacggtcgggctcgccaactccgccgcccagtattggggttcggcgagatcctccgacggctacttctcgatcgcgggggtcctgccggggacgtacacgctgaccgtcttcaagggtgaactctccgtccacagcgcctcggtgacggtgaccgcgggcgccacgaccaccctcaacacgatcacgatcccctcgtcgaacgacccgggcaacgcgagcgcgatctggcggatcggcacctgggacggcacgccgagcgggttcaagaacgcggcgctgatgacgtacgcgcacccctccgatccccgggccgccgcctggaccggcaacgtggtgatcggcagcggcggcgagacctcgtccttcccggcgtacatctggaaggacgtcaacagcggtctgctggtgtacttcaagctgaccgccgcgcaggccgccgccgcgcacaccctgcggatcggtgtgacgacggcgtacgcgaacggccggccacgggtcacggtgaacgactgggtgtcggccatcccctcgccgcccacccagccgagcacccgttccctgaccgtcgggtcgtaccggggcaacaactacacgttcacctacagcgtcccggccgccgcctggctcacggacaccagtcagtacaacgtgctgaagatcgacgtggtgagcggttcgggaacgacggcctacctcagcgcggggacgtcgatcgacgcgctcgacctcctcgcctgacctgatctaccgtcatgtgccacgcgtccactgctggttggtgcctccgttgcaggtgtacgtgatcagcgcggcggagttggcggtggacgcgccggacacgtccaggcattcgccgctcgcgcgggacttgaggctgacgtagccgcccgaggtggtgagcgaccactgctgggaggtcgcggcggtgcagttctcctgggtgacggcggtgacgttctcggtgaggcacagggagctgccccggcccatcagctcgtagtagccgccggcgacggacttgaaccagaacttctggttgttgccgccgttgcaggtgtactgggtgagcgcgacgcccgtgagcagtgactgactggggacgtcggcgcacttggcggagtgccgggcggtcagcgtctcgtacgtggcgctcgtcccgctgatcgtgccggcgaccgtgtcgacggttacctccgggtaccagctcatgctgaggctggtcgaggtggggaaggtcaacggcagccagacgtaacgggagtcgttgacgctgcccccgaaggagttgccccagcggtcgcccaggtagaggtacgaggtgcccgaagtgccctgcacgggaaggacgtacgcggtctgcgagccgtacgccgtcgagtcgccgacgttcgtcatcgcggtccaggggccggccagggaggtggcggtcgcgtactgctgctggttggggttccagcccgtggcgcccgacgtcagcatgaagtagacgccgccccgcttgaagagggcgggtgcctcgcggtgtccgccgtgccaggggtcggcgacgaggctgtcgatgccggtgtagtcggcggtgagccggtagatctggaggtcgtagttctcacgggcggcggacaccatgtaaccggtgccgtcggtgtcgacgaagaccgtgatgtcgcgggacatgtactggccgagcggctggaagctgccctgccaggtgtaggtgccgtcgaccgtgtccgacaccgcgaccgcggcgcgtgcctcgctgtagtcggtgccgttctccttgtgcatccacatcacgaacttgccggtggacgcgttgtacatgaccttcggacgctcgatgttggcgctcgccagctcactcgcgccggcctgggtcaggacgtggctgcggaactcccagttcttcaggtcggtggagcggtaggcgtcgacgtacttgaaggtgttgtcggcgttgcggtcctcgccgaaccagtagtagtagccgccgaccttgatgaccccgccgccgtgcgcgtgcacgccgttgcccgaagtgtcggtgaactgggtgccgttggtgagggtctgggccgccgcccgggccgggcccgcggtcgtgagggcgccggcgaacgcgagacacagggcgaagaggatcacgtacacacgtctcaacccaggggctctccttacggcggtgcgggtgaggggttcgcgggggtcgtgggggtcggggagttgcccactgcggctcgtgtgactcaggcggcttgtgcggctcatgcggctcgtgcggctcatgcagtgaccgtccgtccggtatgtcgaaccttatctgcgattgcgaacgtcgtgaccgccgaaaaggtaagcgcggactgcggtgaggtcaacggggtggacgggacggtacgggcgccccgggcggtcggccggggcgccccgcttctccgagtcgcggcgcggacgacgaggccaccgcgaatttcctgtcggacgagaccaccgcgattttctgctatcggcggccgcccggcccgtctccggtgatgtgcgcagccatttccagaagacgggccgggacgtgacgctcaccggcgacgcggtggtgaccgtgccggccgggacccggatcggctatcgcgggggcgacggcaatgacgtggtcctgaagaccatgacgaagaagcggcggggcgcggcaccgtcggcgtccgccgccccctccgtgaagagcaccgccgccgtcggcgagaacgagggcgcccgcgcgtggtggcccctgttgctcgcgccgccggcggccacgctcgccgtgccggtggtccggcggaatcggtcgcggcggcgcggtggacggcggcacgcggcctcccgttgagccgggggtgggcgacggtcacaccccgctccgcgagctcgctcgcgggtgcccttggcgagccagtacggctgggccgcggccgagaggagggatcgcctcccccgcatcccacatcgtggtcaatctgttcattcactgaacacaacgcggtgtggattgtcgcggcggctcgactaccgtcgtccgtatgaccaggagcaccaccctcgccgaagccctcgccgccgcccctgtcgtgctcgacggcggcctgtccaaccagctggagtcggccgggcacgacctgagcgacgagctgtggtcggcacggctgctcgccgagcggcccgaggcgatcaccgaggcgcacctcgcctacttcgaggcgggcgcggacgtggcgatcacctccagctaccaggccaccttcgagggcttcgccaagcgcggcattccggaagagcgcgcggccgaactcctcggcctcagcgtcgggttggcgcgcgaggcggcggtgcgggcccgcgccgacggcgtcacgcgaccgctgtgggtggcggcgtcggtcggcccgtacggggcgatgctcgcggacggctccgagtaccggggccggtacgggctcacggtcgccgagctggaggccttccaccggccgcgcctggaggtgctcgccgcggcgggacccgacgtcctggcgctggagacggtgccggacgcggacgaggccgaggccctgctgcgggcggtacgcggtctcggcgtgccggcgtggctgtcgtactccgtctccggtgaccgcacccgggccggccagtccctggaggaggcgttcgccccggccgccgaagcggacgaggtgatcgcggtgggcgtgaactgctgcgcccccgaggacgtggacggcgcggtcgagacggccgcgcgcgtgaccggcaagcccgtggtggtctacccgaacagcggcgagacctgggacgccggcgcccgcgcctggagcggccgctccacgttcaccgccgagcaggtcaccggctggcggcgggcgggagcacgcctgatcggcggatgctgccgggtgggcccggcagcgatcacgtcgatcgcggggacgctgggcgagcaagggcgcgcccggccgacggagtgacgtcggtacggccgcgggggggggccggcacgtcagcggccgcaggggtcgtgacgtcagcggccgcagggattccagaaggtgggccgccaccagtagagggtggtgtggtcggtgggccacggcagccgcgcgtccgtctccccgtccgggtcctcgaaccggtcgcgcagggggtcgatcggccgccagtcggggtcgacgggttcgtcgggctgcggcggccggacgaagctaaggtcgcgctgtgtgcatgcgccgatgtcgcgtgcgttcacctgggcgtcgaccagggagatccggttgggcccgtaggcggcggccggcaggcgcagttggacggcgtcgtcctcccagaaacagagcgggcagatgtcgtgggacccgggcggccggtcgtggacgaggcgtccgcagcacacacaggggtgacgttcgccgggcagcgtgcgggccagggcggaccaggaggccgccgcatggccgaagaaccagggcggcaggggctcgacccgctgccgccaggcggcgggaatgcccgcggtgccgacgtgggcggcgacgatcccgccgacgatcgcgcacgtggtgtccacgtccccaccggcagcggcgcaggcccagagggcggccgggtagtcgtcgagatgccgggccgcgcaccacagggtgaacgggacggtgtccacggcgctgaccagtcggccgttgccgagcgtgtgcgcggcgagttcgacatggggctggtcgaggagcaggcgcgcctgctccaccccggcgcgcaccttgctcgcgggcgtgaggtccaggacgacatccagcagcccggccccggtgaccgcctcggcgcgcccgcgggcggcgaagccggctgccaccgccacggcgatcgcgcccgccgcggcctccgggtgcgtgtgcgtcacctcggccgaacgggccgcctgctccgccgccacgggcaggtccgcggcgaaccggacccccagcggggccacccgcatcgcggccccgttgccccaggaaccctgtccctcgaagagcccggcagccaggtcgcgccagggctcgccctgccggaccaggcgcagcagccgattcatcgacgggccgtagccccggtcgaagtcgtggtgctcggcgaaggaccgggccagcgcgtcctggtcgaagcccgccgtgcgcgggacacgcgcgatggagcaggccatttccgtgtcgtcggccagggcccggcgccgggggcagccgccgctcgcgcagcgccggaaggttgtcgggcacgaagaactgggcgccgaaggcatcacccacggcgagaccgttcaagcagtcgcgcgtggcggcgagcacatcgaaggggtcgaagggggtggcggaggcagagggggacgaggaggagggggacgaggaggaggcggcggaggcggaggcggacgggagccggtcgggctggtggtcggatgtcatcgcgggccatgctgcccgtacggcgatcaggccgcgaacgattaacctgtgtcgccgtcgagcgcggcccgcccgccccgcctggaggtcatggcccaggggccggacgccgcctcgacgaagtgtcgccgtgcagggacgacggcctgacggtatgtcatacgtccgagcgacggaagtaacgtacggccgacagcggtgccctgccacgcgcgggcggaccgggcggagggggcgacacgggtgcgggcgtggctgccggacgagtgaactcggctttccacaggccgacttcggcatcgcgcgggccgtgcacgagctcctcgtccgcgccgaagacccggaccgggtgtgagtcgtcccaggccggccagcccgggtcgccgtccaccgcgaagcgcacccaggccgcgtgcatcgcgtcggccagctcctgcggcgcgtcgggtcccgcgagcttcgccgagtccggcacatcgaccgtgtcgaagacgaagcccagctccagggcatgacaggcgccgaggcgggggtggttcgagcgccaggcgaactcgtagacgtacgagggcgcgtggcccgtacgggagtcggccagccggtgcagcggaacgcgcagcagatggtcggtgaccagatggccgaccagatcggaggtgggggccccggggtgggcgaggcgatagccgcgtgggacctccgggccgcagcggcagcgggccatcgcgccggccagggcgaccgggccgagcctgtcgatacgttcgaggagcccggtgggtgcgagccacagccggtgctcctcgctggtccagcccagcagcagggggatgtcccgggcgaggccgccgaggagcgcctcccgcggatcgctcggcaccaggtcaccgtccacgacaatgccgaaggccggtccgccgaggacggggcccgccagtcggccgacctccgcctgcgcctcggccagcagggtgcggtccacctcggcgaacgccgcggcggtcgccgggatcctcagcttcaccgccatccgccgcaccagacgccgcaccttgtcccgctccgtcgactcgggcggcccgctctggagcaccgcccgccggaagaggccccgggcgcgtgggctcgccagcagggcgccgatactgatcgcgcccgcggactcgccgaagacggtcacccggtcggggtcgccgccgaactcggcgacggcgtcgcgcacccactccagcgccgcgagctggtcacgcaggccgggattgggcggcgcgtccgggaagaggccgtaaccctccacacccaggcggtagttgaaggagaccagcaccacgccgtcgcgggcgaaggaactgccgtcgtagacggggaccgccgacgagccgcgggtcagcgcgccgccatggatccacaccatgaccgggagccgggcgccacgacccggctccggtgtccacacattgaggttgaggcagtcgtccccggccaccaccgggtcggacaagaaacgggcgaacgcctccgagtacttgcggtttgggcggagtggggccaaacgctccggcgttgcgcaccccgtcccacggctcctgcggatcggtcggtcgtaaccggcggtggccgaagggcggtgcggcgaaggggatgccgcggaagacggcgacccccttctcgtaccggccgcgcaccgctccgtacggggtacggaccaccgggtccgccgccgggtccaccgccgggtccaccgccgggtccaccgcacggcccgtccggtcgaccgggtcgaccgggtcggcccggcccgcccgttcccctcgatccgtcggtccctccgacccggtcacaccgtccgaacggttcatacggccctctcctcaccacggcgggactgacctcctcaccgcatcacatcatttccgtgtcgcgccgcccgaacggatatgtgtcggccgcggtccgctcttcgcggcgggcgcaactgtccgcacccccggtcttccacgccaccttcacgcgcccctactctagaaagcgcttgctagacggtctgttgccgccgacccgaccgtcgccgttcgaaactttcactcgccccggcgggctggagctggccctcgggacggggccggagaggtgggctcatggtccgtaccggaagcatggccggaccgaccctcgcggtcgtcgcacgggaggccggcgtctcggtgccgacggcctcgaaggtggtcaacggccgggaggacgtggcacccgagacacgccgccgggtcaccgaggcactcgaccggctcggctacgtcaagagaccccgcttcgacacgacgaagtcgcagggcctggtggacctggtggtgcactcgctggagagctcccggtcgggtgcggtgctgcacggtgtggaggaggccgctcatgaggcgggccttgaggtggtggtctcggccgggctgacccggaccaggggtgggcgcccggaacgcggctggctggacaaactgtccgcgcgcggctcgtccggcgtgctgttcaacctcgccgaactgacaccgccccagtacgcctggctggatcagcaccgcatcccgtacgtactgatcgacccggagctcgaaccgccggcgggggtggtgtccgtgggggcggccaactggcagggcgggatgagcgccaccgagcacctgctggcgctcgggcacgagcggatcgcggccatcggcggccaccggcgcaagatgtgcggcggcgcgcggatcgcggggtaccgctcggcgctggccgcggcgggggtccggcaccgtccggagtatgtgcgccacggcaacttcgaccccgccgtcgcccggcggcgcatgcgggagttcctggacctgccggagccgccgaccgccgtcttcgtctgctcggaccggatggcgctcggggtgtacgaggcgctggcggaacgggggttgcgggtgccggacgacatcagcgtcgtcgggttcgacgatctgcccgaggcgcgatgggcctcgccggggctgacgacggttcggcagccgctggcggagatggcggcgaccgcggtgcgcctgctcgtccgcatgatggcgggcgaacggccggagggaacccggacggagttgtcgacacggctggtggaacgggcgagcacggcgccgccgcgtgaccgcgccaccgaggggtgaacgaaaggcgtcgtccggccgtacgtacagtggcggtcctgtctccccggcctggtccgccgcaccctcaccaggcaacgcacggaaggaccttcgggttgtcccacacaagctcccggcaactcccggacaaggacgacacccccacggcggaggacccgactccgaccgtacttccggagcagcaacctgccgaggacggacaccgggacgacgcacaccgggacgatgaggaagccgcgccggccgacaccgagcccgacgccggtgaggccaccgcggcgcaggacacggcccccggcgcctccgcggcgcaggacacggcccccggcgcctccgcggcgcaggacacgaccaagccgggcgacgcctctgcgacggacggcacccccaagccgggcgacgcctccacgacggacggcacccccaagccgggcgacgcctccacggcggacggcacccccgagccgggcgacgcctctgcgacggacggcacccccaagtcggccgacgcctctgcgacggacggcacccccaaggccgacgacgctccggagaccgctcctggtccggaagcggcagcggaggcggaagccggagccggagccgaagccggatccgaagccgcgccggacaccagcgccgtgccggaatccgacccggacccggcggttcccgacccgtcgactcccgacgcggcggttcccgacccggacactcccgacgcggcggttcccgacccggacactcccgacgcggcagttcccgacccggacactcccgacagcgcccccgcccgccccggctggcgtggcaagcaccccgacgccgctcgtgtcctcgcctggacagccaccgggattgccgtcgccctcgtgctcttcgcgcttctcgtgccgaacgacctcgctcgcttcacgccctcccggttcgtacggatccccgcggaggggatcctcggcgccgcccttctgctcgtcctgccgccgaagccccgccggatcctggcggtggtcggcggggtcgggctcggtctgctgaccatcctgaagttcctcgacatgggcttctactggtcgctggagcgccccttcgacctggtgctcgactgggtgctgctggacgacgccgagtcgttcctcaaggactccatcggcgggggcggcgcgctcgccgtcatgatcggggccatcgccctcgccgtcgcggtgatcgcgctcatgacctggtcggtcgtccggctgacccggctgatggcgagcaggcgccacttcgcgggccgtacgctcctggtgctcggcacggcatggatgacctgctcggtgctgaccctcgaggtcgccggtgtgccggtcgcctcgcgcagcgccgccacactcctcgagaaccgcgcgcacgcggtgcgggccggcatcaaggacgggcaggccttcgcccggcaggcctccgtcgacgccttcgccgacaccccgtccgaccagctgctgaccggactgcgcggcaaggacgtcatcttcgcgttcatcgagagctacggccgcagcgcgatcgacgacccggcgatgaccgagccgatcaacgagacgctcacggcgaagaccaaggaactgagcgacgccggctactcgtcccagagcggctggctgcgctccccggtcgcgggcgccggcagctggctggcccactcgacgttcctgtcgggcctgtggatcaagaaccagcagcgctaccgcaacctcacctccggcaaccgtatgaccctcaccgaggccttccgccgcacggacgcctggcgcaccgtcggcatcatgccgggcgtgacgcgcgcctggccggagggcaagttcttcggcctcgaccacatctacgactcgcgcgaactcggctaccagggaccgaagttcagctggtcaccggtgccggaccagtacagcctggcggccttcgagcgcctggagcacggcaagaagcacagcaagccgctgatgtcggagatcatcctgacctccagccacaacccgtgggcccccatcccgaagacgatccccgaggaccaggtcggcgacggctcggtctacgacgccatccacgacgcgggcaaggatcccaaggaggtgtggaaggacccggcgaaggtgcgcgacgagtaccgcaaggccatccagtactcggtcaccagcctcgtcgactacgtcgcgaagcacggcaacaagaacaccgtgctggtcttcctcggcgaccaccagcccaaccgcaccgtcacgggcgacaaggccggccgtgacgtgccgatcgcgatcgtcgcgcacgaccagggcgtactggaccggatctcggactggggctggacggacggtctcaagcccgcctccgacgccccggagtggcggatggacaccttccgcgaccgcttcctgaccgcgtacggccccgagccgacgtcctagggtcggtccggcgggtcacgccggacagggccatacgcctggacctcgcgggcggcccagcggatgccgccgagcagatgggcgcggaagtccgggtccccgtacgcctcggaggcatggccgagcgcggtgtagaagacccggcccgcgcccgcgccctggtcgcggcaccacgccagcgggtggtcgtcgcccatcccgcctccgtcgtacgaggattcgtcggcggaggcgaggacgcgcaccgaaccgcgaggagtggtccggaagtcgtaccactcgtccgtgaactcccacaccgtgggcaggtggtgggtcgaagggtgatcgcggtcctcgacgaccgccttgcccggctggtacgcgggatggcgcgcgaaccgcgcccccagcagttcgccgtagtacggccacgcgtcctccgtacaggccgcggcgtgcacgccgacgaagccaccgcccttgcgtgtgtacgccgcaaggcgcgtacgtccctcgggtgtcaggacctcgccgctggtggagaggaagacgacggcgccgtacgcgtcgaggggtgcctcgaaggcggcggggtcctcggtggcgtcgacgtcgaagccgtgcgcggccccgagggagcgtacggcggcgacggcgtccgggagggaatcgtgccggtatccggtggtgcgggtgtacacgagaacgcggaagggcatgggcggagcctatttccgcagcggggtgcggcccaccgacgcgaggggaccgaaaatttcggaccgcctggcgaggaggacttgtccggctcgggccgtccggcggctcagcccgacgtgccgacgtcgttgttgggcgccccgtcgcccaccgggggcaggtcgcctcgttcgacgggcgcggtggcggtgccgtccggggtgggcaggacggccgccagttcggtgtcgtccgggcggtgcgccgcgccggcggcccggcgcagaacggcgcggccgactgcgttcgcgtcggcgctcacccgcaccacgtgccctttctccggcaccgcgtactcctgccggcccccggccgtgcggtaccacgtgtcgccgtcccgcgcgcaggtgatccgctcccccgacgcctcgccgagcggctgcttcggacagttcgccgccgtcatggtgccccggtccacggagagctggatctgggcgcccgtcttccgggacacgtagacgctggagaagccgtcgccgccgtacacacccaccgactgctgggcgagggtgaatccgggggcttcggtgacgtagacgagttccggtgcgacccccaacgccgcggcgcgggcgtcgagtcgggcacggctcacctcggcacggtccgcgccgctgcctccggctcccgccttctcggtgccgcacgcggagagcaggaccggcagaagcagcagggcgggcaggacggccaaagctttcggaacgcgcgcggcacgggtcatgaccccatcctgccgcacaggtgttccacagaccgggctgcgtgtccgggctgcacgcccggccgcatgtcccggccacacacccggccgcatgtcccggctgcgtgtccgattccttcaagaccggcgatcaccggtccgcctaggttgaacccatgactccacgattcgatgtgatcagcctggcggtctccgacatggccgccgctctcgccttctaccgccgcctcggtctcgtcttccccgacggcgccgagagcgagccgcacgtcgaggccgggctgcccggcgggctgcggctggcgctcgacaccgaggagaccatccgctccttccaccccgagtggcagccgccggccgccggcggccgcctctcgctcgccttccgctgtgacagcccggccgaggtggacacggtgtacggggacctggtgggcgccgggtaccacggcgagctcaagccgtgggacgccgtctggggcatgcggtacgcggtggtgcacgacccggacggcaacggcgtcgacctgttcgcgaacctaccggcgcagtagctcgccgagcggtacgcccgccaactcccgcacgtcccgggcgagatgggcctggtccgcgaacccggcgcgggccgccgtctccgcgaagggcacttgggcccacgcgagcgcgagggcccgttgcagccgcagtacacgggcgagcgtcttgggtccgtagccgaaggcggccagcgagcggcggtgcaactgacgggcgccgacgccgagttcgtccgcggccctggccaccggccggcccgcggccagggacgccaccaccttccgcagcagcgggtcggggcggtccgcctgcgcggcccggtgcagcgcgatctcttccagcgcggtcgcgggatcggcggcggcgtcgacgcgtcccgtcaggcgccgcacctcggcggcgggccacacctccgccaagtcgacgcgccggtcccggagttcgtacgccggaacgcctaggaagaccggcgccgtccccgggaagaagcggacgcccgcccattccccggcagggccctgcggccggtacgcgtgcgtgtccgggccggcgaccaggagccgcccctcggtccacagcaggtccatgcagccgtcgggcagcacgggccgccccgcggcagcggacggcctgttggtccacaccaccgcgcccgccagccgggacggccgctccgcgtacccgggtggcgccgaagcgcgctctgcaaccacgaagaaaaggctacgccgcaggggtgtcggacggcgccctgtgcctgaccggtcctcgtagcggagtcaccgggcccgtcggcaggaggcgagcgcgcgtgccgggtgtcacgtcacggtgccgcgaggaaccgtcggggcacccccggtccggtgctcctgcggactgactccgtacacccgtttgaaggcggtggacagggcgaacgcgctgccgtagccgacctggtgggcgatcgcgccgatggtgtccgcggagtcgcgcagccggtcggcggcgagggcgagccgccagccggtcagataggccatcgggggctcaccgacgagctcggtgaagcggcgggcgagcgcggcgcgcgagaccccggccttggcggcgagcgaggccaccgtccaggggtgggcggggtcgtcctgcaccagccgcagcacccggcccacgaccgggtcggccagcgcccggtaccaggcgggtgcctcggcctccgggcgggagaaccaggcccgcagtgccgcgatcaccagcaggtcgagcagccggtcgagaacgacctcctggcccggctcgtcgcgcacgatctcctcggcgaggatcggcgtcagcgggcacttccactcccgcgaggtgagcgacagcagcggcggcagggcgtccagcagccggccggtgatctcgccctgcatcagataggtgccgatcagcagcaccgtggagccgtcgggccggtcgccccagctgcgcaccccgaggtcccggtggcccttcagggagcgcccgtcggggtaggcgcactcgccgccgggcaggatcaccgcctggggctcggtcgccggggagtcggcgcaggtgtacgggtcggggccgcgcgcgatggccaggtcgcccgccctgagcagcgtccgctcctgcccgtccggcatgacccaggcctcgccccggaccacgagcatgatcgtcagcggggcccggtcctcgacgcgtatgcaccagggcgggtcgaagcacgcccggatcatgaaggcgccccgtgcgcgggggccctccagcaggcctgcgagtgcgtccatggcgtcagcgtagacgcgtacgtatgggaatgagccgttcagcgatggttccgtctgccgtacggcagttgactggccgtatgacgcagaacacgcggaacacgacggtgttggtgacgggggcctcgggccggacgggcagccgggtggccgaggccgcgcgggcggcggggctgacggttcgggcggcgtcccgggcgacggggttcgactgggccgaccgggcgagctgggcggccgcgctggcgggcgccgacgcggcgtacctcatgtaccccacggatgtcggctccccggcggcggccggggcggtcggcacgctggcccgggaggcggtggaggccggcgtacggcgtctggtgctgctctcctcgcgcggggaggagcgggcgcggccgaccgaggaggccctgaaggagtcgggtgcggactggacggtcgtacgggccgcgtggttcgcgcagaacttcagcgagggcccgctggtggaggggctgcgccacggggaactggtgttcccggccggtgaggtgcgcgagcccttcatcgacgtgcgggacatcgcggacgtggtggtgaccgcgctgacggccggggaacggtacgtgggacggacgctcgacctcaccgggccccggctgctgacgttccgggaggcggtcgcggagatctcggcggccacgggcggcacgttcgcgtacacgccggtgccggcgcgtcagtacggggagaacctgaaggcgttcggggtgccgcccgaggaggtggacttcctggtggacctcttcgagagcctgctggacggccgcaacgcgcatctgtcgcaggaggtgcggcagatcctgggccgggcaccgcacgacttctccgagttcgcgcgggagaacgcggcggcgggggtgtggaaggcctaggccccgccgcgagcgtggcacgtacggcccgcgacggccgggcctgccgctccctcgacggccgggcctactgctcccccgccggcgggtcgccgttcttgtgctgcgggtggtggtgcgggctcttcacatgggtgcggaaccgggatgtcacgtcctccggaggcaggaagcgcgaccagcgctccgggaactcggagggcatgtccgggtcgtcgggatcgatgtcggcggcccggtacgcggccacgcgggccacgaacaccgcggcctgctcctcgagcagccgctcgttcgcggcgcgcgccgcggccgtggcggcggccggccagacccggtcgatggctgcgttgaccgccgcgccgaccagcaccgcgaacgcggacacaccgatccacagcagcacggcgacgggcgcggcgagcgagccgtagatcgtgggcccctcgaccgtgctggtcaggtagatgcgcagcaggaagctgccgagcacccacatcgcgagggcgaccagggcgcccgggacgtcctccacccagggcgagcgcaccggcacggagacgtggtagagcgtcgtcaggaagacgatggacaggacgatgacgaccggccagtacaggacctgtacgacggtcgtcgaccacggcacgacgttcaccaccgcgtccgggcccgccaccatcagcggcagcgcgaccgagccgatcagcagcgccacgatgaagagcaggaacgacatcatccgggtcttcacgatgccgcgcgtgccgtcgaggccgtacatcacggtgatggtgtcgatgaagacgttcaccgcgcgcgagcccgaccacagggcgaacaggaagcccagggagatgacgtcggggcggccgcccttcatcacgtcgtggaggagcggctgggcgatctcggtgacgcccttgtcggacaggaccgtgcgggacgcctccaggatgttgttctccaggctggcgatggtgtcggcgccggtccagtcgtcgacgtagccgagcagcccgatcatgctcagcagcagcggcggcacggacagcagcgtgaagaaggcggcctcggccgccagaccgaggatccggtactccatgcacgagttgacggtgtccttgagcagcagccaggcggtcctgcgcttggagacgttccggtagagggcacgcgcccggtggaaacggccggagggcctctgcgggggttcacttgctggctgcacgccctaaaggtatccgccgcgcgaggctgcgctcatcccgtggtgcgggggccgggccgcgagccctggcctaccggcggaagccctggtgaccgacgtagtaccgaggggtaggttgcgagacatggctgccagcacccacaccgtgaccaaccaggctccgcccctggtgggctatgacgtcttcgccgccgaccgggccctcgtggaggccgtcgagcggcatctcgatcccgcgctcctcgacgaggcgcgcaccgagctgtcggggctcgggctcagcgccggctccgcgcaggtacaggagtggggggccctggcgaacgagaacccgcccaagctgcggacgcacgaccgctggggcaaccggatcgacgaggtcgagttccatccgtcctggcaccggctgctcggcaagggcgtgtccgccggactgacggcggcctggtcccggcccggcgggcacgtccggcgcgcggccggtttcgtgatctggacgcaggccgaggcgggcaacggctgtccgctgtcgatgacccacgcggcggtgcccgccctgcgcaccgacccggcgctcgcggccgagtgggagccccggctgacctccatggtctacgaccaggggatgcggcccgccgcccagaaggccggtgccctgttcgggatgggcatgacggagaagcagggcggcagcgacgtacgcgccaacacgacggcggcgcggccgctcgccgaggacgggacgtacgagctgacgggccacaagtggttctgctcggcgccgatgtcggacgggttcctggtgctcgcgcaggccgcctccgccacggacggagggggtctgacctgcttcctcgtgccgcgcgtgctggaggacggcacgcgcaacgtgttccgcgtccagcggctcaaggacaagctcggcaaccggtccaacgcgtcgagcgaggtcgagttcgacgggacctgggcacgccgggtcggcgacgagggccggggcgtgcgcacgatcatcgagatggtggcggcgacccggctggactgtgtcctcgggtcggcgtcgctgatgcggcaggcggtggcgcaggcgatccaccactgcacctaccgggaggcgttcggcggcaagctggtcgacaagccgctgatgcgcaacgtactggcggatctggccctggagtcggaggccgcgacgacgctcgcgctgcgcctggccgccgcctacgacgacggcggcgagcaggagcgggcgttcctgcggctcgcggtgccggtcgccaagtactgggtgaccaagcggtgcacgccggtggcggcggaggcgctggagtgcctgggcggcaacgggtacgtggaggagttcggtctggcccggctgctgcgtgagtcgccgctgaactccatctgggagggcgcgggcaacgtccaggcactggacgtgctgcgggcgctccagcgcgaaccgcaggcgctcaacgcgtacctccaggaggtcggccgggcgcgcggtgccgatcaccggctggacggcgccatcaagggcctgctcacggagctcgccgacctggagggtatcgagggccgggcccgccgggtggtggagcggctcgccctcgtgctccagggggcgctgctggtgcggtacgccccgccggaggtcgccgacgcgttctgcgcctcccggctgggcggcgactggggtacggccttcggcaccctgccgcacagtctggatctggccacggtggtggagcgggcccggccggtggcgtgacgccgcgggggcgttcccccgggcatacgtcgcgggggtggtgctgcgccgacacggcaccacccccgctgcttcggccccggtcagggaccgcggacgccgcctgggcgacgtcgcacaagtttcaaacaccgcagggccgctcgccagggttgcaggaggttgcaactatctgttggctgtccgctcactgtggccggagtgtatccctccgtcaccttcgggcggcagtatgggaggagcagtcgacacccggccgggcccgccgccaaggcgtgcgacggacgggccctcctggaggttcgtgtggcgcactcgccgaaggatgtgacgcggctggtcgcccgggacgccgcgcaggcggcgcgcatgctcagggaggtgcgcagcgcgacgctcgccgggcagcgcacccgggtcgcgccgcgcccggtgatcgaggcgtcgtgggggcgcatgcggcgcagcggggtggatcccgaccacgatgtcagggcggggctgctgagcctcgacgaggtcgagcggcggcgccgggagtcgccgctgcgggtggtgcttccggtgctgcgcgaggggctgttgtcggtcgcggacgtcgcgcagcacatcatggtggtcgcggacgcggacgggcgggtgctgtggcgcgagggcagtccggcggtgctgcgccaggcggacgggctcggctgcgaaccgggcgcggactggggcgagtcggtcgtcggcacgaacggggtgggcacgcccgcggtgaccggccgtcccgtgcaggtgttcgcctccgagcacttcgtacgctccttcgcctcgtggacgtgcacgggcgccccgatcacggacccgcgcgacggccgcctgatcggtgtggtggacatcagcggtccactggagacgatgcatccggccacgctcgcctgggtggactcggtggccaagctcgccgaggcgcggctgcgggaggtgcatctgacgtcactggagcggttgcgcgcggtggcggcgccgctgctggcccggctggacgggcgggcggtggcggtggaccgggacggctggacggcggcggtggccggaatgccgtacgccagacggctggcgctgcccacctcactgacggccgggcggagttgtctgccggtgctgggcccgtgctcggtggagccgctgccgggcggctggctgatccgggcctgtgaccgggcaactcccgcgcacaccacgcggatcgtcctggacctctcccacccgcgccgctggtcggtgacggtctcgggagacacgggttcctggacgcacgaactgacgccccggcacgccgagttgctctacctcctgaccctgcaccgcagtggccgcacggccgcggcgctggccgccgacatgttcggcgacccggcccgcacggtcaccgtccgcgccgagatgtcccgtgtacgacgctatctgggcgctttcctggaccaccggccgtatcgtttctccgaaaccgcggaggtcgaactcctggccccggacgacccgctggacctgctgccccactcgatcgcgccggcggtgctgcgcgtgcgtacggcggggcccggcggcggcgtttccctcctggcgccgggcggcgggccggtctgaatgctcccgatgtgcccccaggtcgagggattaccctcgtaattaccgggtcttcgaccgggcacaccctccgctcgcgtagcatccctcccacaggccaccccaccagctcctcgatcaacgcgccgaccacggggagtagttggcctacctcgggaggtcccatgaaacagcgtggcagacatcgtcgcaggaggaggggccgtgcgctgcgcgccaccctcgccggaaccgcgctggcgctgaccgccgccgccacgctgatcagcacctcccaggccgccggcggcgacaacccgggagccctgaccccgctcacctccgccgccgagaccggcaagctgcaactccacgagaacctggtcggccggaccaccctggacacgctcaccagcgacatgggcggcaacgtcggcgtgcacggcgtgctccagagcgccaaccactcgatgcgcaacaaggccgactgtgccgccaccgaggcggccgcgctgcccgtcgagccgagcgcctcgcgcgcgtactgctgggacagcggcgacgcgacgacccagaagtggctgccccagtccgtcaccacgtccggcgacgccgacaacgacggcacgtggggcgacgaccgcgtcatcctcgcgggctggacgcacaacgaccacaaggcgggcgagccggccgacgaccagggcctcgcccgggtcgccttcatcgacgcgaacgacccggacaacctcaagtaccgctgggtcctgctggtcgccccgctgagcggcgacgcggacttcggtgccgtccgctcgcatctcggcggcatggtctggtaccaggacaagctgatcgtcaccgcgaaaaacggcgcggaccacaacaacgccctcttcgtcttcgacatgcaccgcatcctgcgggcgaacgtcgacagcagcgcggtcggcaaggtaagcggcggctacgcggcccacggctaccagtacgtactgccggccatcggctcgtacgacctgaccggcggcgcctgcacctcgggcaacgacaacgcggtcccctgcttcgcctccgtctccctcgaccgcacctccaccccggacagcctggtggcgaacgagtggttcagctcgggcggcacccagcccgcccgggtctggcgctactactacagcaccgccgcctcccgcaccggtctgctcggcagcaactccagcgacgtcgtcaacgcggacgaggcgtacgagaccaaggccgtcggtctccagggcgtgctgtcgcacaagccgagcggcgcgagcacgccgaactggtacgtcgaccacgcgcccggcagccgcggcaagcacggcaccctctggcggcagaacaaggacggcgcccgggcggcgcggtgcacgaccgaccagacgaccgcctgctggggccggcacaccgagtccatgtcgctctggcaggagaccggcgagctgtggacgctgaccgagtgggcggcgaacaaggacgcccagtgggagccggacgccatcccggagcgggtgctgtacgccgttccgctgtcctccgtggacgactcgctagggtaggcctggagcgggcaacgtcacccgcgtccccgatcacccccgatcgacagcccggggggccgggtgattttctgaccgcatgagcgacatcaccgtgaccacctggtccctggagcagacgtcccccgccgacctgcggcccgcgaccgcccccgacggcgaggtccggatcgtccgctccgaggtgccctcgccggagttcagccggttcctgtacgcgtcggtcggcggcgacatccgctggaccgaccggctgtcctggacgtacgagcagtggcaggcgtacctggcgcggccgggcgtggagacctgggtcgcccacgaccggggcactcccgcgggatacgtcgagctggagccgcaggacgacggggtcgtggagatcgcctacttcgggctgataccggcgttccggggccggcggatcggcggccatctgctctcgtacggcgccgcgcgggcctgggacctggccgcgcgatggccggaacgcgccgagaccaagcgggtctggctgcatacatgcagcaaggacggagagcacgcgatggacaactacctgcggcgcggtttcacgctcttcgacaccaaggtcgaggcggaggcggacgtggccgcaccagggccctggccgggagcgcgcgccgcctgacctgcacgtacctgtccggcgggcccggccggacaccaccggccgggccaccgtgtgatcaacgacaccccagtctcacccttcgggaccagggtgtccacatgatggatgacggtggactggcccgagatccccgtgacacgcttccgtcatgtctggaactggaattgccttggtgagtcggcggcacgtcgacctcggccgcatgtccagcgccatctgtccggcgagctgagcagtccagcaccgccgagtcactcctctttcgagaaccttgcgcaaggacgcgcccgtacttccgtatgcgcccgtacccgcaggtcagagccgctcccctgtctgtcccgtagtcccgaaggacgtatcagccatggccgccaccccgcagaatcccgccgccgcgccccgccgcaaggtgagccgtcaccgcggtgagggtcagtgggccgtgggtcacttcaccccgctcaacggcaacgaacagttcaaaaaggacgatgacggtctcaatgtgcggacacgcattgagacgatctactcgaagcgcggcttcgactcgatcgaccccaatgacctccgtgggcgtatgcgctggtgggggctgtacacccagcgcaagcccgggatcgacggcggcaagaccgcgatcctggagccggaggagctggacgacaagtacttcatgctgcgcgtccgcatcgacggcggccggctgaccaccgagcagctccgggtcatcggcgagatctcgcaggagttcgcgcgcggtaccgccgacatcaccgaccggcagaacatccagctccactggatccgcatcgaggacgttccggagatctggcagcgtctggaggccgtgggcctgtccacgaccgaggcctgcggtgacaccccgcgcgtcatcctcggctcgcccgtcgccgggatcgccgaggacgagatcatcgacggcacgcccgcgatcgacgagatccaccgccggatcctcggcaacaaggacttctccaacctgccccgcaagttcaagacagcggtctccggctcgccgctgctcgacgtggcgcacgagatcaacgacgtcgccttcgtcggcgtgaaccacccggagcacggccccggcttcgacctctgggtcggcggcggcctgtccaccaacccgaagctcggccagcgcctcggcgcctgggtcccgctcgacgaggtcgcggacgtccacgtgggcgtcctgtcgatcttccgcgactacggctaccggcgccttcgtacgcgtgcccgtctgaagttcctggtcgccgactggggcgtcgagaagttccgccagatccttgaggacgagtacctgaagcggaagctcgtcgacggccccgcgcccgaccagcccgtcgccagctggcgcgaccacgtcggcgtgcaccggcagaaggacggccgcttctacgtcggcttcgccccgcgcgtcggccgcgtggacggtacgaccctcaccaagatcgccgaggtggccgcggcgcacggctccgggcgactgcgcaccaccgtcgagcagaagatgatcgtgctcgatgtggaagagggccaggtcgagtcactcgtcgaggggctggaggcgctcgacctcaccgtcaagccctcgtccttccggcgcggcacgatggcctgcaccggcatcgagtactgcaagctcgcgatcgtcgagaccaaggcgcgcggcgcttccctcatcgacgaactcgagcgccgcatccccgagttcgacgagccgatcaccatcaacctcaacggctgcccgaacgcctgcgcccgtatccaggtcgcggacatcggtctcaagggccagctggtcctcaacgaccagggtgagcaggtcgagggcttccaggtgcacctgggcggcgcgctcggcctggaggccggtttcggccgcaaggtccgtggcctgaaggtcacttcggacgagctgcccgactacatcgagcgcgtcctcaagcgcttccaggcggagcgcgaggacggcgagcggttcgccacctgggcggccagggcttcagaggaggcgctgtcgtgacggcgagtgagccgaaggggcgcaccccggaggcgaaccgagccacaaaaagaggggaggcgctgtcgtgagcgagcgtgccgcgcccttctactgcccctactgcggcgacgaggacctgcgcccgagcgagcagggccacggcgcgtgggaatgcggagcgtgcaatcgagccttccagttgaagttcctcgggctgctcgcccgggggtttcagcccaacgacggtggaggggacgagatatgaggacggttcaggccgacacggacaccggcacagagcgtgcgaccggccgcgacgcggagctgaagacgctcgccgagcaggccgggcgcgacctggaggacgcctccgccctggagatcctccagtgggcggcggacaccttcggcaagaagttctgcgtgacctcctccatggaggacgccgtggtcgcccacctcgcctcccggaccttccccggtgtggacgtggtcttcctcgacaccggctaccacttcccggagaccatcggcacccgcgacgcggtcgaggccgtgatggacgtcaacgtcatcacgctcaccccgcgccggacggtcgccgagcaggacgcggagtacggcccgaagctgcacgaccgcgaccccgacctgtgctgcaagctccgcaaggtccagccgctggagcagggcctgaccgcgtacgacgcctgggcgacgggcctgcgccgcgacgagtccccgacccgggcgaacaccccggtcgtcagctgggacgagaagcgccgcaaggtgaagatctcgccgatcgcccgctggacccaggacgacgtggacgcgtacgtcgcggagcacggcgtgctgaccaacccgctgctgatggacggctacccctccgtgggctgcgcgccctgcacccgccgtgtgctggagggcgaggacgcgcgcgccggccgctgggcgggcagcaccaagaccgagtgcgggctgcacggatgacgacgacgaccgagaacccccagacctcccgggagaagcaagtgacgaccggagccaccatctggctcacaggtctgccgagtgccggcaagaccaccatcgcgtacgagctggccggccggctgcgcgaggagggccacctcgtcgaggtgctcgacggtgacgagatccgcgagttcctcaccgcagacctcggcttcacccgcgcggaccggcacacgaacgtgcagcggatcggctacctcgccgacctgctggcccgcaacggcgtcaaggcgctcgtcccggtgatcgcgccgtacgcggacagccgcgaggcggtccgcaagcggcacggggcgagcggcgccgcctacctcgaggtgcatgtcgccactccggtcgaggtgtgcagccagcgggacgtgaaggggctgtacgccaagcaggcggcgggcgagatttccgggctgaccggtgtcgacgacccgtacgaggcacccgcttcgcccgatctgcgcatcgagtcgcacacccagaccgtgcaggagtccgccgccgcgttgcacgcgctgctgaccgagaggggtctcgcatgacgaccgcagccaccgcttcccaggagaccgacagcccgtacgcgctctcgcatctggacgcgctggagtcggaggccgtccacatcttccgcgaggtggcgggcgagttcgaacggccggtgatcctgttctccggcggcaaggactccatcgtcatgctgcacctggcactgaaggccttcgcccccgcggcgatccccttcaccctgctgcacgtggacaccggacacaacttccccgaagtcctcgcataccgcgaccgtgtggtcgccgcacacggactgcgcctccatgtggcctccgtacaggactacatcgaccgcggtgtactgcgcgaacgccccgacggcacccgcaaccccctgcagaccgtgcccctgaccgaagccatccagcagcaccgcttcgacgccgtcttcggcggcggccgacgcgacgaggaaaaggcccgcgccaaagaacgcgtcttctccctgcgcgacgagttctcccagtgggacccccgccgccagcgccccgaactgtggaacctctacaacggccgccacgcccccggcgaacacgtccgcgtcttcccgctctccaactggaccgagctggacgtatggcagtacatcgcccgcgaacacatcgaactccccgagatctacttcgcccacgaacgcgaggtcttccagcggtcccacatgtggctgaccgccggtgactggggcggccccaaggacggcgagactgtcgagaagcgccgggtccgctaccgcaccgtcggcgacatgtcctgcaccggcgccgtcgactccgacgccaccacgctggacgccgtgatcaccgagatcgccgcctcccggctcaccgaacgcggcgccacccgcgccgacgacaagatgtccgaggccgcgatggaagaccgcaagcgcgaggggtacttctagccatgaccagcaccaccgagcccaccgagccgctgtcggtcgagcagttgtcggccacgaccctgctgcgcttcgcgaccgcgggctccgtcgacgacggcaagtccacgctggtcggccgtctgctgcacgactccaagtcggtcctgacggaccagctggaggccgtggagcaggtgtcgcgcagccgcggccaggacgctcccgacctggccctcctcaccgacggcctgcgcgccgaacgcgagcagggcatcaccatcgacgtggcgtaccgctacttcgcgaccgcgcgccgccggttcatcctcgccgacacccccggccatgttcagtacacccgcaacatggtcaccggcgcctccaccgccgacctggcggtggtcctcgtcgacgcccgcaacggcgtcatcgagcagacccgccgacacgccgccgtcgccgcgctgctgcgcgtcccgcacgtcgtgctcgcggtgaacaagatggacctcgtcgagtacaaggagtccgtcttcgccgcgatcgccgagaagttcacggcgtacgcctccgagctgggcgttcccgagatcaccgcgatcccgatctccgcgctcgccggtgacaacgtggtggacgcctccgcgaacatggactggtacggcggccccacggtcctggagcacctggagaccgtgccggtcagccacgacctggcgcactgccacgcccgcctgcccgtgcagtacgtgatccgcccgcagaccgccgagcaccccgactaccgcggttacgcgggtcagatcgcggccggtacgttctgcgtcggctccgaggtcacggtcctgccctccggccgtacgtcgaagatcgccgggatcgatctgctgggcaccccggtcgacgtcgcgtggaccccgcagtcggtgaccctcctgctggaggacgacatcgacatctcgcgcggcgatctgctcgtgccgagcaaggacgcgcccgccaccacccaggacgtcgaggcgacggtctgccatgtcgccgacgctccgctgaccgtcggccaccgcgtactgctgaagcacggcacccgcacggtcaaggcgatcgtcaaggacattccgtcccggctgaccctggacgacctctccctggcacccgcacccggggcagctggtcgccaacgacatcggccgcgtcaagatccgtaccgccgagccgctgccgctcgactcgtacgccgactcccgccgcaccggcgcgttcatcctgatcgacccggcggacggcacgacgctgaccgcgggcatggtcggcgagtccttcgccgcgcccgagccggtcaaggacgcgagcgacgacgacgggtgggacttctgatcatgaccaccaccgacttctactccacgttcgcgaaggagggcggccgcgtcggcagcggcgccctcggcagcgggcagggcggagtcgcgcgatgtgcgcgatgacgtacgcgcactgcctgcgcgccctgtccccccacccgacgtcccggacgcgacgaagacctgccgacctcccggccacgacctgaaagaccgtgaccgccgggccaacgaggggaacacctcccgtgcctgccaaccgttccacgctgatccgccgcgctgtggccgcggccgccgccctcccgctgctggcgctcgccgcctgcggttacggttccgagtcgaaggacgacacctccgcgaaggagaaggtcgccgccggggccaagaagatcgacggtctcgacaccgtgaagatcggctacttcggcaacctcacccacgccaccgcgctcgtgggccgccaggagggcctcttccagaaggaactcggcgccacgaaggccgagtacgccaccttcaacgccggcccctccgagatcgaggccctcaactcgggctccatcgacatcggctggatcggcccctcgccgtcgatcaacggctacaccaagtccaacggcaagagcctgcgcatcatcggcggttcggcgtccggcggcgtcaagctcgtggtcaaccccaagaagatcaagtccctgaaggacgtcaagggcaagaagatcgcgaccccgcagctgggcaacacgcaggacgtcgcgttcctcaactggatcgccgagcagggctggaaggtcgacgcgcagagcggcaagggcgatgtcacggtcgtccgcagcgacaacaaggtcaccccggacgcctacaaggccggttcgctcgacggcgcctgggtgccggagccgaccgcgtcgaagctggtcgccgagggcggcaaggtgctgctcgacgagtcgacgctgtggcccgacaagaagttcgtgatcacgaacatcatcgtgtcgcagaagttcctcaaggcgcacccgaaggtcgtcgaggccgtgctgaagggctcggtcgggaccaacaagtggatcaacgccaaccccgacgaggcgaaggccgcggcgaacaagcagctggagaccgactcgggcaaggccctgccggccgatgtcctggacccggcctggaagtccatccagatcaccaatgacccgctggcctccaccctcaacaccgaggcggaccacgcggtgaaggccggtctgctgtcgaagcccgacctgagcggcatctacgacctcacgctgctgaacaaggtcctcaaggccgacggcgcgagcacggtcgacgacgccggtctcggcgtcaagtaggtccggatcccgatgagttcccaggaggtgacgaccatggccacgaccattgccaaggccaccgacagcgtcggcgtggtggagcacgccgctcggatcgagcacgtctccaagtccttcgccgggccagccgggcggcagctcgtcctcgacgacatcaccctcgatgtcgcgccgggcgagttcgtcaccctcctgggggcctcggggtgcgggaagtcgacactgctcaacctggtggcgggcctcgacgccccgaccacgggcagcatcacgaccaaggggcgaccggccctgatgttccaggagcacgccctcttcccgtggctgaccgcgggcaagaacatcgaactcgccctgcggctgcggggagttccgaaggccgagcggcgcgacaaggcggaggaactgctcgaactcgtacggctgaagggcgcgtacggcaagcgggtgcacgaactgtccggcggtatgcgacagcgcgtcgcgctggcccgtgcgctcgcccaggacagcgggctgctgctgatggacgagccgttcgcggcgctcgacgcgatcacgcgggacgtcctgcacgacgagctgacccgcatctggcgggagacgcagttgtccgtcctcttcgtcacgcacaacgtgcgtgaggcggtgcggctcgccgagcgggtcgtgctgctctcctcccgccccgggcgggtggcgcacgagtggacggtggacattccgcagccgcgccgcatcgaggacaccgccgtggcggagctgtccgtggagatcaccgaacaactgcgtggggagatccgccgtcatggccagcactgagacaacgtcggcggacgctcccgccaaggacaacacccaccacgacctggccggtctggaggcgggcctcgacgcactggagacggtgcaggtcgggcgtacgccgttccggcaggtcttcgtgcagaagatcctgccgccggtcatcgcgatcgcgctcgtgctggtggtgtggcaggcgctgatctcgttcaagatcgtcactgacccctccaagctgccgccgctgtccgcggtgtggaacgagatcgagaacgcctggctggagggcaagctcctcggctacatctggaccagcgtctcccgcggcctgctcggcttccttttcgcgctggtcatcggcaccccgctgggcctgctggtggcgcgcgtgaggtttgtgcgcgcggccatcggcccgatccttcagggtctccagtcgctgccgtcggtggcctgggtgccgccggccgtggtctggttcggcctgaacaactcgatgatgtacacggtgatcctgctcggcgccgtcccgtcgatcgccaacggcctggtgtcgggcgtcgaccaggtgccgccgctgttcctgcgggcgggccgcacgatgggtgcgacgggcctgcggggcacctggcacgtcgtgctgccggccgcgctgccgggctatgtggcgggcctgaagcagggctgggcgttctcgtggcgttcgctgatggccgcggagatcatcgcgtccttccccgacctgggcgtgggcctcggccagctgctggagaacggtcgcaacgccatcgacatggccatggtgttcgaggccatcctgctcatcctggtcgtcggtatcgccatcgacctgctgatcttcagcccgctggagcggtgggtactgcgcagccgcggtctcctggtgaagagctgagcccgtcatgcaccgaccggtactcctcgtcatcgcccacggcagccgcgacccgcggcacgccgcgaccgtgcacgccctggtgcgccgggtacgcgccatgcgtcccgggctgcgcgtggagaccggcttcctggacttcaacgtcccgtccgtgaacggggtgttggagtctctggcggcggagggcgtccgcgaggtggtggccctgccgctgttgctcacccgcgccttccacgcgaaggcggacatcccggcggtcctgcgggaggccccgtcacggctgcgcatccggcaggcggaggtacttggcccgtcccccttcctgacggccgcgctggaacggcggctgtacgaggcggggctgacccccgccgacagaccctcgaccggggtcgtactggcctcggcgggatccaccgacccggaggcgatcgcagtgatcggggacatcgcgcgggagtggcggcgcaccggctggtgcgccgtgcgacctgcgttcgcctccgcgtccctgccccgcaccgaggacgcggtgcgggagctgcgggcactgggctgcgagcggatcgcggtcgccccgtacgtcctggcccccggcttcctgccggaccgcatcgcacggggcgcggcggaggcggacgtcctgtcggatgtactgggtccggcgccggaggtggcccacgtgctgctgaaccggtacgacgaggcgcgggtaccggcgctggccgccctgggcgcctgagacacccgggcgggcgtccccgttcagtggatcgaagttcagcggcctggccggaactcagccgagggacagccttcccgtacgagggtcccggccgctcgacgccagggcgcggtcgaagacgggcgcgtcgtccggcaccggcaccgggtcggcgaatccgtcgtactggcggtagaggtcgccgtgtgtctcgaccacggcgaggacgaaccgggccgcgccgtccgagacgcggtactcctggccggtggccgtcgcgacgtcccagccgtggaccgccagctccttgatgaccatcgaggcgatgtcggtggcggacaccttcgccatgccgaggtcgacctcgccctcccacaccgccgggtccgcccaggcggcgaccgcccggtccagctgggcggcgtacgcctcggcccagtccggttcggcggtgaagtcgcgcgcggtcagctcctcggggagctgcttgcgcagggcgcggtgctccaggccgtgcgaggtgtagaggacccagtggttgaccagggcacggacgtcccagtcggggcagtgggtgggatcgctcagctgtgccgccgtgacaccgcgcgcgacacgggccgcctcggcggcacattcgatcatgtacgggtgcatgtcgtcgttcttcatgcgcctcacgctagaaacagccggctcaagtctcttgaacaaacgcgacagcatggccggcaaggcgtacgagctcgcgcaccggcatcgacccggccggccgccgctcccgtgcgaactggttggcgagccgctggagcagctcgttcagcggagtcggtacgccgtgcagccgccccagcagcgcgatctcgatcgacaccgcggacaactacggcccgtccaccaagggcggcgtcgtacgcaccggtgacagcgcctggcacatcaccgggcgcccggagcagctgcgggcgatgtgcgaggcgagcctgcggctgctgcggctcgacacgatcgacctgtaccagttgcaccggctcgaccccggggtaccgatggccgaccagctgggcacgctcgacgcgttgcgcaccgagggcgagatccggcacctcgggctcgacacggtcaccgccgaacagctcgaagcggcactggagttgacggacatcgcctccgtgcagaaccgctacaacctgctcgaccgtgcgtcggaaccgctgctgtcccggctggacagcctggggtgaccgtgggccaggggtcggacgcgagcaggcgcggttcggcctcggcggcggcctcggcggggtggtgctcaggcgccggtcagctcctccagtttgacgaccgtgttccagttgcggctggtggcgacgatccccttgaggaggcggggcctggccagggtctcccccagcttggagcggccgaggccgtcaggggcgtacagatagagcgcgcggtcgcccaggcggaactcctccggcaggaaggccggctggtcgagcgaggcgaagcgctccgcgtcgaccggcccggagaaataggtgacgtggagctgcttggcctccagttcggcggccgggaaggggcaggcctcgcgtacggccttgagataggcgtggtcgcggacgaggacgtcgacggtgaagccgaagcgcttctcgatggcctgcccgacctccgccgccagggactgctcgtcgccgtggtcgctggtgaagacggcgttgccgctttgcagataggtggccacgcccccgtacccgagcccctggaggagcgtccggagctcggccatcggcaccttcttgttgccgcccacattgatcccgcggagcaaggccgcatacgtcgtcatccgcccaccctagagcggccgtcgtgccgcgtgggacgggtacggcgtccgcggccggtggtccgctcgccgcccgggggacacagtccgcgcccctgatccgtgtccccgagatccccggatacatgtaggggaccactgtcctcccagatgctgaggccgtccggtccgaggggaggactcgtccacccggcggatcaccaaccagcacgacgagtcgttcttatccggcccataccttcgtagtgaaggtgacggcagggggctgtcaccgcatttggagggggcagtccgtcatggcgaacggagaaacaacgcgggtccggggcatagcagcccgggccggcggctggagcgcccggcaccgctgggcagccgtcggcatctgggtgctgttcgtcgtcctggcgatgggactcggttcggcggcgggccaggtcaaggtcaaggagagcgaccagctggggggcgagacccacacggccgccaagatcatcgaggatgccgggatcgaggagccggccagtgagaccgtcctgatccaggtcaggaacgggtcgtccaaggccaccgacgccgggttccgcgacgcggtcgacgcggtgatgcgggcggtcgaagacaccggcaaggcgacggacgtgacgtcgccgtacgacacccggaccatctcgaaggacggccggagcgcgctcgtgcagttcgacatgcgcggcgagtcggacaccgcgggcgagcgggtcgagccggtgctgaaggccgtcgagggtgtccagaaggaccacacggagctgcggatcgaggagatcggcggcgccagcatgatgaagcagtacaacgacgcgttcggcgacgacttccagaaggccgagtactccgcggtgccggtggccctcggtattctgctgatcgccttcggcgcgctggtcgcggcgctactgccggtggccctcgcgatcaccgcgatcatggcgacgatgggtctgatgggcatcgtcagccatctgcagccgatggacgacaccgccagctccgtgatgctcctggtcggtctggcggtcggcgtcgactactgcctgttctacctgcgccgtgagcgcgaggagcgggcggcgggccggagcgcggacgccgccctgcgcatcgccgccgcgaccagtgggcgcgccatcatcgtctccggaatcacggtgtgtgtggcgatggcgggcatgctgttcaccggcctcgccacgttcgaggcgatgggcctcgcctcgctgatggtcgtggcggtcgcgatggtcggatcggtgaccgtgctgccggcgctgctctcgctgctcggtgagcgggtggagaaggggcggattccgttcctgcacccggacaaacggcgtaagaacggcaacgccgccaagggcaacggggaaagccggttctggggagccgtgctccgggtcgtgctcgccaagcccggtgtcgcgctcgtcgtcgcggccggcgcgctgctggcgatcgcggcgcccgcactcggcatgaagacccagaacctcacgctggaccaggagttcggcgattcactgccgatcgtggggacgtacaaccgcgtcaacgacgccttccccggcggctccgagccggccgaggtggtcgtcagggccaaggacatcaacgccgccgacgtgaagtccgcgctggccgacttccgtacccaggccgtgagttcgggtgcctcgcgcgggccggtcgagatcaaggtgcacgacgcgcagaacatcgccttcgtctatgtaccgctggtcggcggctccgaccaggacaaggccggccagagcctggacctgctgcgcgacaaggtgcggcccgacacgctcggcaaggtcgacggcgtccaggcgccgatcaccggacaggtcgcggggaacaaggacttcaacgatcagctgatcggctcggtggccccggtcttcgccttcgtcgtggtcttcgccttcctgctgatgctggtgtcgttccgctcgctgacgatcgcgatcacctcgatcgtgctcaacctcctttcggtgggcgcggcctacggcatcctggtcggcgtcttccagcacggctggggcgcctcgctggtcggcgcggagggcgtgggcgccatcgtcacctggctgccgctgttcctcttcgtgatcctcttcgggctctcgatggactaccacgtcttcgtggtctcgcggatccgtgaggcgcggctgcgcggccggagcaccaaggacgccatccagcacggtgtggtgaccacggccggagtcgtcaccagcgccgccgtcatcatggtcgccgtcttcgcgatcttcgggacgctgtccatgcagtccatgaagcagatgggcgtgggcctggccgccgcggtcctgatcgacgcgacgatcatccgcggcgttctcctccccgccgtgatggccctgctcggcgagcgcaactggtacctcccgaggtggctgaaccggctgccggacctcacccacgacgagtcacccgagccggtgtcgccgcctcagccgcccgccgtggagggcgagcgggtgggagtctgacgacaggttcgacgcgcgtacgtggccggggtgtacgcaccccggccacggtgctgtccgcgtgggctgctcaggccgcccgggccacgtcgtcgcgctcgaaggagtcgatcgtgcgggtgaagtcgcgggtggacagcagcagcttgtagatgatggcgagctcgaagacgaggagcagggcaccggacacgatcgtcgccccgatcaccgagtcgaggaacgggccgatgatgaagacgcccatctggaattcgatgccgctcaccaggtgggtgcgaatgcggtggcgcagcaggaaggaacgtgccctcagataggccgggaagcggtgccggaactcctcgtgcaggtcgatgacctgggcctgggggcgggccgccgtgccgccttcgggagcctcctgcccggccgcggcgctgcgctggtcctgctcgatgtccgcctcgggattgttgcgcagcaggtcttccatgaaggccagctcggcctggttctcggaccggcgcgcctccctcaggcgggacttgatctgcttgcgcatcgaatggcggatcttgaagatttccagcgagttgatgtagcgcagggtgtccaggccgatcacggcggcggccagccagatgtacgtcgtgtctccggagcgctcgtactgcccggccatcaacgccaccgcgcacaccgccacccggatgcggtcgaagacgaagtccagccaggccccgaacaccgagccctggccggtcagccgggcgaccttgccgtccatgcagtcgaggatgaagctcaggtggtagacgacggcaccggcgaccagccagcgccagtcgccgagcgcgaagcacaccgccgaggcgagaccgagcaggaacgcaccccaggtgagctggttcggcgtgatcctcgtccgcagcgcgacctgccgcacgagcggggtggcgaccgggtcgacgagcagcacggtccaccaggcgtcgcgcttcttctgcgtgatgcggcgcacctcgggaaggggcgggaggtctcggcgtagggagggcataggtcaacttcctggcgttcgactggaattaatctcacgttaggaatcctcttaccgagagaacaagatcccgctcgtgcaaccttcccgagggggtatcggtccaactccactaccaagtccatgtctttttccggcagttaccgcgttatccgagcgttaccgaatgacccgaccgttatccaaagtgcgccaggacttcaccggtcgcgtgcaacctttacgccagggaaaccgtggactcgcggacagtcacggttctccgcctcgaacggtcctgggcccctcagcgctgatagcgagccagcaccagatttccgtcctcgaccagccgctttctcagctcggccaggccgatcgccccgctgtagtactcctggaacgcgggggtcgcgaccttgtccttccactccgggtagccgcgtacggactgggcgggagccgaacggaggtgggcggcgagtgcggtgccggtcgcccagtcgtccatggcggtgtgcagggcggggtccttgagggcctcggtgcccgtgggcagcatccagtcgccgagcgcgagccggaccatgttcttcggccggagcaggaagtcgatgaactcggcggcctccttcttgtgcgggctgtccgcggcgacggacagcgtctgcgggctgacgccctgggcgagcccgtcggcaccggccggcgcgggcagcacctgccactcgaaacccttcggcgcctgttgcgcgatctgctgccggtacgagaagccgagcgggaccatcgcgtacttcccaccgaagaacccgggcagcgtgtcggaaccgcccataccgagcgtgctgcccgacgcgctcccgtcggtgttcacctcgtcgtgcacggtgcgcggcacgagggcgtcggccgcgtcgaaccgcaccgtcaccttgccgtcggcaccccggtggaacatctgtccgccggtcgagagggacaggttgagcgtggccgagacgggttccttgagcggccaggcgacgccgtacttgcccttgccgctcagctgaccggcgatccggcggaactcgtcccacgtccacggccgctcgggggtcggaatgcgcacccccgactccttcagccaggtggcgttggcgatcagcacccttggctcctggaggaacggcaccccgtagatcccgtccccgaaggtcgccgtccgccaactccgctgcgggatgtccgacatgagccgggcgggcagcagttcgcgcagatcggcgagcgagccgccgtaggcgaagtcggcgaggtcgtcggacgcgtcgtggatgacgtcgggcgcctcaccgccctcgaaggaggtcagcagctggtcgtggacgctgtcccagcttccctgcacgtatgcgacctggacggccggatgcgtcgcgttccactcctcgaccagctccttgttggcagcgacggactcctcctgccaggcgagggactggaagcggagggtgatacggccgccggagccgtcgtggtccgaagaacatcccgcgagcagcagccccagcgcgacgagcgcggtgatccacctcctgcgcatcagctcttcaccgccccggtgagcatgccgcccgtgatccgccgctggatgaccgcgaagacgaccagcgagggcagggtggcgaggaacgccgccgcggccagcgggccgaggtccgcgacgccctccgcgccgatgaagtgtgtgaggacgaccggcagcgtctgtttctgcggggtcttgagcagcaccagcgcgaagaagaactcgttccacgcggtgatgaacgcgaacagtgccgtcgccacgatgcccggcgccagcagcggtgcggtcaccgacaccagcgtgcgcgcccgcccggcgccgtccactgccgccgcctcctccagctccaccggcacggcccgtacgtacccgaccagcatccacagcgcgaacggcagcgcccacaccacgtacaccatgatcagaccgggcacggagttgatcagccgcaggtgcttgaggaccaggaacagcgggatgatcaccagaacgaacgggaacgcctggctgaccaccacccagcccgtggcggcccgggcgaggagggtgcggcgccgggccatgacgtaggccatcggagtcgcgatcagcacggcgatcagcgccgctccgagggccgcgagcagggagttgagcgcggcgtgcagcaggggctgctcgtcgaaggcctgccggaagttggcgagcgtcgggttcctcgggatccaggtggggtgcagactggccagctcgcgcggcggtttgaaggccgtggagatcagccagaggaaggggaaggcgaggaagacgagataggcgagcagtgcgacgtactggccggcgcgggccctcttgggggtcttcacgcgtcttcgcctcccttcagacggcccaccaggaacacggcgaggagcaccgagatcaccgcgaccagcacacagcccatcgccgccgcgtaaccgaactggccgtagcggaaggcctcttcgtaggcgaagagcatgggcaggcgggtgcggccgccggggcctccgttggtcagcacatagaccagggcgaacgagttgaagttccagatgaggttgagcgcggtgatcgccagcgcgaccggtctgagggccggccaggtgacgctcaggaagcggcgccaggcgcccgcgccgtccatcgaggccgcctcgtggagttcacgcggggtgttctgcagcccggcgagcagggcgacggtcgtctgcggcatgcccgcccacacgccgacgacgatcacggcgggcagggcggtggacagaccggacagccagtcgcggccgtcaccgaggcccagatcgcggatcgtctcgttgaggatgcccgcgtccgggttgtagacgagccgccacatgatgccgacgaccacctcgggcatcgcccagggaatgatcgcgagcgcccgtgccgcccagcgcagcttcaggtcctggttgagcagcagggcgagcccgagcgcgagcaggaactgcggcacggtcaccccgaccgcccacagcagcccgatccggaacgagtcccagaacagcgtgtcctgcaccaggtcctggaagttgagggtcccgatccactgcgtgggcgcggtccgccccgactgggagtcggtgaacgccagcgcgatcccgtacagcaggggtccgacgctgagcacgaggatcgggagcaacgcgggcagcaccaggaaccaggcgccctggccggtgggcgtccggccccgcccggcgggccgcggcgggctcttcactgaccgcttcgtcacggtcgccaatgtcacgaaatcggctccttcgggcgactcgcaccggtctggggcctggtcgccacgatggcgtcgtccggcaggcgcccctgcgccgaccggccccagcgtccgggcggccccgtcatggtcctgagggactgacgcgacgtcaagacagcgtgcaagcccttgtaggcggcccgaccagcgccaatgcgacactttccgtcggatggcgtgttcgtgacgccgtacgcgcgaggaacacggaggcgaacgatggacgaggcacaggcgcgggacgtactggccacggcgagcgtgctgcccgggccggcccgggacgcgcggcttctcgccctgggcgagaacgcggtgttcgccgccggtgacctggtggtcaaggtggggcgcgacgccgagctcctcgaccgcgcacggcgggagctggagatcgcgcactggctcgccgacaccggcgtccccgcggtgcgggccgccgagcccgaggcgcggttggtggacggccatccggtgacggtgtggcatcggctgccggatccggtacgccccgcggagccccgggacctggccgaactgctgcgggtggtgcatgccctgccctccccctccttcgacctgccgccccgcgaactgctgggcggcgtggagcgctggctgcgtctggcgggcgacgcgatcgatccggcggacgcggcctatctgcgcgagcgccgcgacgggttcgccgcggccgcggccgcgctcactccgcagctgccgcccggcccgatccacggcgacgcactgccccgcaatgtgcacgtcggcccgggcggtccggtcctggtcgacctggagaccttctccgccgatctgcgcgagcacgacctggtggtcatggccctgtcccgtgaccgctacgggctgcccgccgaggcgtacgacgcgttcaccacgacatacgggtgggatgtgcgggagtggacgggcgctgccgtgctccggggcgcccgggagaccgccagctgcgcctgggtcgcccagcacgcgccgagcaatcccaaggcactgaccgagttcgagcggcgtgtggcgtcactgcgggacggggacgagacggtgcgctggtaccccttctgagtaccctgccttcccggccgcccgtcccggacgtccgctcagaccgtttcgtccgccggctcccgcagcggccatgtgccgtccacgaccgccgccgtgtcgcccttgcggcgcaggaagctctggaagtccgccgcccaggccgcgtaccactcgatctggcggcggtgcagctccgccgggccgagcgcggcgatcttcgggtggcggtgggctatcgcggcggcgagccgggccgcggccagggcgtccgcggtcgcgtcgtgcgcggcgtccagggggacgccgtactccgtgcagaccgcctcgaggttccgcttgccgcggcggtagcggtccacccagcggtcgatcgtgtacgggtcgatcaccggtgccgggtcgcggccgtcgagccgctcgcgcagcgacggcagtccgtaccggcgcagttcggcggacaggagggtgaggtcgaaggtcgcgttgtacgccacgaccggcactccggttcgccagtaccccacgagggtctgcgccagggactcggcgacccggtcggggggaccgccctcggccgcggcccgctcattggtgatcccgtgcacggccaccgcgtccgccgggatctccacgcccgggtcggccagccactcgcggcgtccgaccggctcttgacccttgacctctatgaccgcgccggtgacgatgcgcgcctcgcgcggatccgttccggtcgtctccaggtcgaagccgatcagcagctgctcgtgccaggccatggcggccccccttcgtggtggtgctttcccccagtggtctccaccctcccacgcgccactgacaatccggcgaccgcgttccgcttcgccggtccgggcgaccccgcggacgcaccgcgcccgcccggaatgcggactcgtcaggacacaggccgcgaatccgcccaagccagttcgaactcctcgcggtaggtcgggaagagcccgctgtcgtcgacgtcgtccgccttcaccacccggcccccgccgcgcagcaccaggaccggcgcttccatgccgcgggtgcgccgcagatacgactgcaccaccgcgatgccgtcggagccgtctccgtcgacgagatacgcggtgaagcgaggcgtctcgtcgtagacctggatctcgaaggcgcccgggtcgcgcagcttggaccgcacccggcgcatgtgcaggatgttcatctcgacggcgcggctcatctcgccccgcttgatgccgagttcgcgctcgcgccgcttcaccgcgctggacgcgggattcaggaacagcagacgcacccggcagcccgactcggcgagccgtaccagccggcgcccggagaagttctgcacgagcaggttcaggccgatgccgatggcgtcgaggcggcgggcgccgccgaagatgtcctcgcccgggaactgccgcagcagccgtacccggtccgggtggacgccgaccacgtccccgtaccggtcgccgaccatgtcctcgaccgcgtcgacgggcagccggcgtgcggacggcacgtcgctgcccgcgccgaggatctccaggagcttcgccgaggcgcgctcggcctggccgagcaccgcttcggacagggccctgttgcgggagacgacgttacgcgtcacctccagctcgtccagggcgagttcaacgtcgcggcgctcgtcgatgtacggctcgaagcacggccagtgctgcaccatcagctcgcgcagctgcggcagggtgaggaaactcagcacgttgtcgtcggcggggtccagcaagtagcccttgcggcggctcacttcgcgtaccgcgaccgcccgctggacccactcctggccggccggtccggccgcggcgaccacccactcgtcgccgtggacgggttcgtagatggggcgcagaacagcggccacgaccgcgcgcagccgctgttcgacgaggttcagccagatataggcacggccggcccgctgggcgcgcgtacgcacctcgcgccaggcgtccgtgccccagtccagttccggtccgatggatcccatttccatcggccgtgccagggacaccgcgccgggtgggacatctgtggagttcccctcgtgaccctcgtcaccagggggcaactccagccctcccgagcccacccacgcaccgccttccgctcccccgagctctcccctgtggctgatcccagccaacgatcaaggaagggtactccgggagcagcgggcgatgcagccggatggacagtgtcgtttctcaactaccgttttccacatgcccgttctggtcggccagctcggccggagtgagcggattcatagcggtgacatcgcgcggagctatcgagaagccctgccagtgtaccggcatcggctgctggtcctcgtcccgggcgatgtggtggaaaccgacgttgacccaggcgatcgggtgggtgagggtctgtccgccgacccacttgtcgacggacttaccggctccggtaccgcagttgcgcaggttgtcgctggcgaactgttcacacttcttgtactcggtgaagtagatgtcgtgcttggtgaagctgcggccggggtacttggtggtggcgcccgggacgatctcgtaggaacgcgcgtggtcgtccttgttcttgccggtcgcgctgacgacccgccaccagcgcatgttcttggcgtcgcccgcgagttccttggtgatcttcgtgcgggtggtcttgttggtcgggccctcgttgccccgggcgggcgcggtgaccacggagtcgtactgctcgaccgtgttcttcgaggagccgtccagaccgaagttgagccgccagaagatgttgtggctgtggctggtcgcgtacgccttggcgcccttgccgaggggccagccgcggccgtcgccggcgtcgtagtcgacgggcgagaggctgccggtggcgccgacgttcatgttgatcgtgccgtcgtcctggaagcgccactcggtgatgtactcgtaccagccgacctggttcacggtgtagaccagcaggtccttgccctgggcctggaagaccttgttcgccgtgtcgccctgcatgcggtaggcgtggccgcgcgaacgggtggtggtgcacagacccttgacgttcgggtgctgcggatcccaggcgcccgggaccttgacggtcttgatggtgccgccggggcactcgccgggcgccatgttcatcaggccctggccgaagcccgcacccgtgaggtcgctgtactcggctttgccgtcgtcgtaggggacgtggatctggccgagcttggcgctggtgaggaccttgatcggccgtgtctcaccgggcggctggtacgagatgttctccaggacgagcccggcctcgctctcgtagtgccagcacatctgccaggtggtgccggaggcgagcttctgctcgatccggtacgccgcgctgcagtcggcggccgccgcgggtgccgacttggtctgggcgacggccggtcccgcgaccgtcgtcgcaccgacggcgagcgccgccacggacagggacaccgccgcccggcggcgggcccggctgattctgttcacgcgcatgaagaagtgactcctcgcgaaaagcaggaagaaggaagggaaagaaggaggggagagaagagaggggacgaggggggacgagagagcgggagagagcggcagaggaacagaaaggaaggcggagcgttggaaaagcgaacggaccgcggctcagccgagcttgcccaccttgcgcgcgctcaggtcgaccaccaggtcacggctgtcgatccagggcccgttcctgaccttcgggaacagccgcacgcagcggtggtcaccgcactgcgcgaggaccgcgggctgggcacccgaggtcgcccggtaggccatgctgttgagcagcagctgatcgggcgaggtgagttccttgccggtcgcgtccttgaagtcggccttcaggcccgcgccgagcgggtcggcgatcagcagcctggccgcctcgacggcctcgtcggagctgatcggcggctggacgccgtgctgggtgtcggtctgctcgaccttcccgctgtcgaggttgacggtcttggtgacgagcgtgtcgtccttgtagtcgtagaaccgcacgtcggcgcggcgcggcgcgttcgcgccggccggcgcgttctcgtcctgctccgcgaggtcgacgccgacgcgctgtgggccgcgcctgccctcgacgttctcgctggagccgaagaactgctggttcaccgcgatctgcgcgacccgcttcgtctcgtcgtcggtgagggggtcgcggcccgtgcccttctccccctcggccggggcctgctcgacgacgccgggctgcgccgccgcctgcccctgctgcccggcctgtccggcctgctgggcggactggccggcgccctggccgccctgttcgtcggcccccgccgagcccgggagcgtgatgccgaccatcaccgcggtaccggccacagcgatggccgcgcctgccaccaccttgcccagatggcggtgcactatcttgcgcacatttccccctactcctccggtctccaggagtgtcttgagccccactggttcggcatggcgcgtatgcgtcggcgtagtgcttatgtgacggcatagcgcctatgcgctggtcgcccgctaagagggacgtaagccataggaggttccatcactttcggggagactcggcagggagtcgcccccaggggcccgggacaactggaagagtcgtatccatgcaggtctggcctggagaggcatatccactcggcgccacgtacgacggcgccggtaccaatttcgcggtcttctcggaggccgcccatcggatcgagctgtgtctgctgcacgacgacggctcggagacggcggtggaactgagggagaccgacgcgttcgtgcggcacgcgtatctgcccggcgtcatgccggggcagcggtacggcttccgcgtgcacggcccgttcgcgccggggcgcggggtgcgctgcaattccgccaagctgctgctcgatccgtacgcgaaggcgatcagcggcgagatcaagtggggcgaggaggtgtacggctaccacttcggcgcccccgacaagcgcaacgacctggactcggcgccgcacacgatgacctcggtcgtgatcaacccgtacttcgactggggcaacgaccggcggccgcgcaccgagtaccaccacacagtgctctacgaggcccatgtgaagggcctgacgatgcggcatcccgcgctgcccgaggaactgcgcggcacgtatgcggcgctcgcccaccccgccatcatcgaacacctgactgaactgggcgtcaccgcgctcgaactgatgccggtgcaccagttcgtgaacgaccaccgtctggtggacatgggcctgaacaactactggggctacaacacgatcggtttcttcgccccgcacaacgcgtacgcctcctggggcgaccgcggccagcaggtgctggagttcaagtcggcagtgaaggcgctgcacgaggccgggatcgaggtcatcctggacgtggtctacaaccacacggccgagggcaaccacatgggcccgacgctctccttcaagggcatcgacaacgcgtcgtactaccggctcaccgacgatccccgctactacatggacaccacggggaccgggaactccctcctcatgcgctccccgcacgtcctccaactgatcatggactcgctgcgctactgggtcagcgacatgcatgtcgacggcttccgcttcgacctcgcggccaccctggcccggcagttccacgaggtggaccggctgtcgtcgttcttcgacctggtccagcaggacccggtggtctcccaggtgaagctgatcgccgagccgtgggacgtcggcgagggcggctaccaggtgggcaacttcccgccgctgtggaccgagtggaacggcaagtaccgcgacacggtgcgggacatgtggcggggcgagccgcgtacgctcgcggagttcgcctcccgcctgacgggctcgtcggacctctaccaggacgacggccgccgtcccctcgcctccatcaacttcgtcacctgccacgacggtttcaccctgcacgacctcgtcgcgtacaacgacaagcacaaccaggccaacggcgaggacaaccgggacggggagagccacaaccggtcctggaactgcggggccgagggcgacaccgacgatccggcggtgctggcgttgcgggcgcgccagatgcgcaacttcatcgccacgctgatgctctcgcagggcgtgccgatgctcagccacggggatgagttcgcgcgcacccagggcggcaacaacaacgcgtactgccaggacggcgagctgtcgtgggtggcgtggcccgaggacggcagcgagctgctggagttcacgcgcgcgatggtgtggctgcggcgcgaccatccggtcttccggcgccgccgcttcttccacgggcggccggtggagggcacgcacgacgagctgtcggacatcgtctggttcacgccgacgggtgaggagatgatccagcgcgactgggattcggcgcaggcacgggcgctgacggtgttcctcaacggcaccgcgatctccgagcccggcccacgcggagagcggatctcggacgactccttcctgttgatgttcaacgcctccccgaagtcgctggagttcgtggtgccggtcgaccacggccgccagtggcaggtcgtcgtcgacacggcacgcacggacgggatcccgccgggcacggtcgcgaaggtcaaggccggggaccggctgacgctggtggaccggagcctcacggtgttgcagcggccggcctgatcagccggacaggcccggggtgaaccgttcaccccgggcgtggcggagcgctgcggacgcgccgtccgcccgtggccgggcggcttcggcgcggacgcggtccgggtggtcggccggttccacgccctggtcgggcgagcgggccctggcggccgatccgtcctgaccggcgccggacgcaccacggaccccggctcctcccccggccggggcgccgggcagcacccgtgggggacggccgtccgggcgagcgctccaccgtccggacctgcgggggccgggagccgccgggggcgtccggccgagcgccgacggtacgtctcgcctgtgcccccgcccgccctcgctgtccgtgtcgcacgaatccagccacccgcgcggtgacccgtgcacgcgtcgatgacacgaaagaccgcgaggcgggtacgtagggttccatgacacctgagcgtcccgaacccacggtgcccacggccacgtaccgccttcagctccagccggagttcccgttcggtgcggcggaggcggccgtgccgtacctggcctcgctcggcgtctcgcatctgcatctgtcgccggtcctcgagaccgtaccggggtcgttgcacggctacgacgtcgtcgaccacgcgcgcgtgcgggacgaactgggcggcgagaggggactgcgctccctggcgcgcaccgcgcgggagcacggcctcggcctggtcgtggacatcgtgccgaaccacatggccgcggccccgcgccacaaccgccccctctgggaggtgctgcgcgagggaccggattccgcgtacgcgcactggttcgacgtcgactgggacgcacagggcgggcagctgctgctgccggtgctggggcaaccgctcggcgcggagatcgaccggctgaaggtcgacggcgacgtgctgcgctactacgaccatgtcttcccgctgcgcgagggcaccgggaagctgccgctgccgcagctcctcgatgcccagtggtatcgcccggtgtggtggcggctggcgcgcaccgaactcaactaccggcgcttcttcagcatctccgagctcatcggggtgcgcgtcgaggacccggaggtcttcaccgcgacgcacgccaccgtgctgcggctgctcgacgagggtgtcgtcgacggcctgcgcatcgaccaccccgacggtctcgccgacccggacgcgtatctgcgccgcctccacgcggccaccgggggccgctggaccgtcgtcgagaagatcctcacggacggcgagcacctccccgccgcctggcccgtcgcgggaaccaccggctacgacgccctgcgtcacgtcgacgggcttttcacggacccggcgggagcgggcgaactcctcggccagtaccggcgtttcgcggccccccaggccgatcgcggcggccactgggaagcgaccgtgcggcgcgccgcgtacaaggtggtcacccatgagctggccaccgaggtggaccgcctcacgcgcgcggcgagccgcctgtgcgccacctccccggaccccgccctgcgcgaccacgccccctgggcgctgcgcaccgcgctgcaagagctcctcgtacgtctcgaggtgtaccgcccgtacgcctccggggacgccgccgcggtcgtcaccgaggaggccgccgccgaggcccgtgccgtcttcacggtgcccgaggaggccggtgcggtgagcgtcgtacgggatctggcgctggggcgggccggtgacgggcccgggcacctggagttccgggcccggttcgcgcagacgtcgtcggcgctgcgggccaagtccgtggaggacacggggttctatcgctacgtcccgcttctgtcggcgaacgaggtgggcgggaacccgggcagtccggccgtctccccccaggacttccacgcgtactgcgcgcgcgtgcagcgcgactggcccgcgaccggcaccgctttgtcgacgcacgacacgaagcgcagcgccgacgtgcgcgcggccgtctccgtgctcacccagtgcccggagcgctgggccgacacgctcgcggaggtgacccgcgccggcgacggcgtgcccgacccgcacgtcgcctgggccgcctggcagacggtcctcgggctcggaccggcggccgaggagcgcgtacaggcggccctgctgaagcacgtcagggaggccgggctgcacaccgcctggaccgagcaggaccccgcgtacgaggagacggtggcggcgttcgtcgcgcagggcccgtgcggggcgccggggcggctcgtgacggacttccgggccgagttgggcccgcatgtccgggcgaacgttctcggggccgctctggtccatctgacgatgccgggtgtgccggacgtctaccaggggacggagggcgagtaccgggcgctggtcgacccggacaaccgtggggtgttcgcaccccaggagcagccctcggcgaagtccgcgctcacgacggcggccctgcggctgcgcgggcggcgcccggaggtcttcggtgacgcggcgacgtacgagcccctcgaggccgaggggccgggcgccgcccactgtgtggccttcgtgcgctccggggaggtgctcacggcagtgacccggctgtcgctgcggctggcggaggcgggcggctggcgcgacacggccctcgcgctgccgccgggccggtgggccgacgcactcgccccggagcgggagttcgagggccacacgcgcgtggtggagcttttcgggtcctcgcccgtggtgctgctggagcggctcgggggccgagtgggcggcgtacaggcgacggtggccggaccgcggtgacctgaaggggtggtcaacgggcgtcgagaagggccgtcggcgggagcggccgggccgtctccggggccccgcagtcggcgggccgcgcgatgccgtcctcgcaggcctccgcgggcgccgccgggagccctccataccggcgcaggagctccacgaaggccgcggcggcacccgagggcggcacgcgggagaagaccgtcaggggacgcctccagggcgggtccacggagagtacgacgcagtcctcgccgaccgcgccgcgcacgatgtgcgagggcgcggtgctgacgcccacaccggccgccgccatacgcaccgccgtcgaggtgtgctcggtgaacacggcggtacgcggccggaatccggcctgcccgcaggcccagtcgagaaaccgctgtccgtgcacgacgggctccatggcgcaccggatccacgagcggtccgacaactcgggcagcgtcaccgtcgtacggcccgcgaaacggtcgtcgaagggcaccacgaggacgatctcctcctcgccgaccggcacgacgctgccgggccagtcccgcggcgcgggcccgaccgcgaggtcggcggtgccgcgctcgacctgttcctccagcgcctcggaggtggcgtactcgtggaggtgcagcacgacctgggggtgggcggtacgccagcgggcgaagacgtcggggagcacccccacggcgacggagtggacggccgcgatgtgcagttcgccgccttcggctccggcggaggcgcgggccgcgcggcgggcctgggcggcgctgcgcacggcgagttcggcgtgcgggcggaaggcgcggcccatcggggtgaggcgcaccccgcgcggcatgcgctccaggagcgcaccgccgaccgacctctccagggccttgatctggtgcgagagcgcgggctgggtgacatggagggtctcggccgcgcgggtgaaggacgcctcttcgacgacggcgaggaagtactccatctgccgcagactcatctcccccgccttccatgagcattctgcatggcttccacaagaacattgccttggatctatgacaaggggagggcggaaggtggagaacatgaacacaccggacgtcatcgtcatcggaggcggcaccggcggctacagcgccgccctgcgcgccgccgccctcggtctgaccgtggtgctcgccgagcgggacaaggtcggcggaacctgtctgcaccgtggctgcattccgagcaaggcgatgctgcacgccgcagaactggtcgacggcatcgccgaggcgcgcgagcgctggggggtgaaggccacgctggacgacatcgactggcctgcgctcgtcgccacgcgcgacgacatagtgacgcgcaaccaccgcggcgtggaggcgcacctcgcccacgcgcgcgtgcgcgtcgtccggggcagtgcccggctgaccggtccgcgcagcgtccgcgtcgagggtgctccggacgacctgccgggcggcgcgggcgacttcaccgcgcgccggggcatcgtcctggcgaccggctcacggccgcgtacgctcccggggctcgtgccggacgggcggcgcgtggtgacgagcgacgacgcgctgttcgcgcccggcctcccccgctccgtgctggtcctgggcggcggtgcgatcggggtcgagtacgcctcgttccaccgctccatgggtgcggaggtcactctcgtcgaggccgccgaccggatcgtgccgctcgaagacgtcgacgtcagccgtcatctgacgcgcggtctgaagaagcgcggcatcgatgtgcgggcgggggcgcggctgctcgacgccgaactcctggaggcgggggtacgcgcgcgcgtacgcaccgtgcggggcgagatccgcacactggaggccgagcggctcctggtggcggtcgggcgggcgccggtcaccgacgggctggacctggccgccgcgggcctggcgacggacgagcggggttttgtgacgccgtccgactgggaccgtctggagaccgcggtgcccggcatccacgtggtgggcgacctgctgccaccgccgtccctgggactggcccacgcgtcgttcgccgagggcctgtcggtggccgagacgctggccgggctgccgtccgcgcccgtggactacgcggccgtgccccgggtcacgtactcgtcgccgcagaccgcctccgtggggctgggcgaggcggaggcacgcgcgcgtggacacgaggtggacgtcaacacgatgccgctgaccgccgtcgccaagggcatggtccacggccggggcgggatggtgaaggtcgtcgccgaggagggcggcgggcaggtgctcggcgtgcatctggtgggcccccacgtgtccgagatgatcgccgagagccagctgatcgtcggctgggacgcacagccctccgacgtggcccggcacatccacgcgcaccccacgctgtccgaggcggtcggcgaaacgtttctcacgctcgcgggacgggggctgcatcagcagtgaggcccgccgcggagggagccggaccgcccctgcgaggacggggcacgccgtcaacgcctcttggcgccccctggcgccgccccgtcttctccttgacagttccccccggccgtggactactgcggattgcgacgtcgggcggaccaaacgggggtgagtctcctgccggagcagcgctaccccagtgtgaccgaaatcgtttcgtccgcccgcgcgctggcggctcaccggcccggcctgtgcgcgctcagacaagtcggtgtctcccgcgcgggccgacctctgcacctgctgtccgtcggccacgcgacccgtgccgtcctggtcgtcgcgggcgcccacgccaacgagccgaccggcggttcgaccctgctgtcactcgccgaacgggtgctgtacgagcgggagttgcgggacggcacctcctggcacttcctgctctgcgcggacccggacggcgcggccctgcatgtgactccggcgccgcgcacactgttcgactaccacctcgggttcttccgtccggcgggccccgagcagccggagtggtcgccgtccgtgctgccgccggaccggctgccgcccgagacacgcgcgctgacccgggtcatcgacgaactgcgcccctaccttcaggtgacgctccacggcaccgatctgggcggcagctgggtgcagttgacgaaggacatccccggcctcgccgagccgttcgcgaagtccgcggcggagctgcacattccggtggagacgggcgcctccgacgcggcgggctggcccgcgtccggtcccggcgtccatgtgatgcccgcgccgggttcgaacgcggcgtacccgagcatgcccgacgacgcccggcacagcacctggtaccacacccatcggtacggcggtctcaccgcggtcgtcgaggtcccgatgtgggcgagcgacctggtggacgatccggcgccgcacccggcgcccgcggcggccctgcggcagctggggcggcggctgctgcgggacgcgctggaggtggaactggtcctcacggaggcgctgccgcggctgcccggccccgacgggccgctgctgcgcgccgccaagtgggcgctggagctggtcccggggctcgcgggcgactgggcgcaggcgccgcccgcggacaccacgatggcgtacgtcggcagtgtcgacgcgttcggccgccggctgccgctgcgggccgccgcgatgctgctgcgggtcctccaggaggccgacgaccgcgccgcgccgcgcctcgaacagctcgtcgcggcctggagcgacgccttcgccgtacgcttccgcgcgcgctgggtccccctggaggaccaggtcgaacatcagtcccgtacggtcgtggcggcggcccggcacgcgcgggaccgtgcggcgtgacgtccgggctccggaaagagcccgccgggcgcgccccggtcagctccgcagaccgggcgtcggcccgtccgacgcctgctccgagagcgcgaacaccgctccggtctccccctccaacccgcaggcgttcccgaaggcgtggcggtactcgacgtgccgcccgttccactcgccgtgcgcgtccgcggtcaccggggcgtagatcatcgggcagaacgtgcgcttgggcgggatccgggtgatgtccccgtcggcggccgccagttcctcgcacgcccgggccgcgtgcgcgtgcccgtggggcgggtcgcacgtcaggagcctgctgatgtgactggagcgggcgtcgcccgtggtgaccgtcacatagagccagttgccgggggtcacccggtgggccgccgcctgggccggggccgcgctgagcagggcgatcgcggccagcagggcgccggggaccgccatggtcgtcttcgtcattccgtatgcatcggcacgacggcgtccgaaccccagcggggctcacccgaatgcgagcgcacgggcgcgtaccgccccgcgagttcgaacgcggcgagcaccacgcgcgtctggtactcgacctggtggccgaccgggacccagcgcgccccgtagccgtcgcggtagtcggcgcaccactcgtcgatgagccggtccagctcggggaggacgtcggacgccgcggctccggcggccgtggcgagttggcgcagcagcccggcggtccgcagggcgacccggcggcccgagatgcccagcgcggtcagccgggcggtgttgagcggcggcagcggccggcccgtgccgtcgaacgtgtcgggatcccaggagtcggcgagcccggggccgaccagtaaatagtcgtcgaccggggcgagcagactggcggtgtcgggggtggcggcgagccgcggccggatccgggcgaggatgtcctccagaaggcccgtgtcgcggcgcagggtgcggctgacggcgcgcaggaccgcgtcggcgtcgccgggcggtgagccgtcctccacagccgccacgccccacatgggcgcctcgacgaccgccgtcacggtgccgtagcgctgcgggtggaaccaggtggattcgaccgcggcctccgtgatggcggcggccaggtcgccgcggcgcggcggtgggatgcggtagacggcggggcccaggggcggccagtacagggtgtcgtaggggccgagttcgcgcgggatgccgaaccgggcggcggtgcctgcgacgcgctgggcgaggccgggcaggtcctgggtcagttcgacgaagccgccgccgacgtccacgccgtgcagggagcactggaagaagggccgcagctcgtcctggaggtcgaggagggcgcgggtttcgggcagggcggcccgctcggcgccgtcgggcagccactcgggctgctccaggaagcccgggcggaagaagtgccggaagtagtggccgagggtgtacgggcccgacagccagccctcgttgcggcgcgcgccgtcggggtcgaggcagagcagcaggttccaggtggcgtcggcgccctcggccggcccggggccggccaggacccgctcggcgaggcgcagggcggtggcgccgcccacgggttcgttggcgtgcggtccggcgacgacgagggcgtggcgggtgccgtggccgacggacagcagccacaagggcgtgccgccccgggacgtgcccacgcggcgcagccgggcgtcgcccggacggcgggcgacgagcgcggcagcccgcgcggccagttcgtcgacagtcgggtagcgaaggagtggcggcagggcgcacctccactcatgtggtgccgtcggttcacctggtgtgcatggtgtacgcacagtcagtcacggctcggcaggtacgtcaacaccgcccggggcgagggaaggccgggcggacacggcacgtgacaccggggcggggtctcgctccggcgcggcccgccgtgcacaccgggcggcgcaacgcgcaccctggtgcggggcgccgaccgccgtcggctactccgtcgcgagccgaaaggccatgttcccgaagctcacctggtcgccgtcacggacgaccgcggcgccgatcacgtgacgcccgttcaccgtcgtgccgttggtggatcccaggtcgcgcagcacccacaggccgccctggcggctgagttcggcatgcacacgcgagacggtgtcgtgactgagcctcagaccgctggcggggtcgcggcctatccgcagcgggtgcgtgctgccggggtgcggcaggagcagcttggggagccgctcggcctgccaggccctgcgcagccgtacggtgaagccggagaccgcctcgaccgtgccgaacaccagccgcgacacgcgcttctcggcgggcaggtcggcggtgagcgcggccagttcggcgggctggcgggcgaccagcgccagttccatgcgccggatgaacgtgtcgtgcgagaggcgtcccagggctacgccgtcgcggagcaccttcagcgccctgtcgcgctcggcgtccgacagccgcgcggggtacgtgtggaactcgaaagacgacgtcacgcaggtgattgtcgggcagtcgggccagggtgtccagaaaaccccggaaacggacgtcgtctccgtcagggtcgttccgcgtggcaaaagggtcgattcaacggcgaattgatctcgattgacgcaccatggactggctacatcacgatgagcagacgagggggaaccgtccgtgcagttcgaggtgtgggcaccacaggccgcccgggtgacgctccactgcggcggcgccacgcgcgcgttggcgcgcgacgaggagcgcgacggctggtggaagggcgacgcggaggccggggacggcacgcggtacgggttcgccctggacgacggtgccgtgctgcccgacccgcgctcgcgccgccagccggacggcccggacgggctgagcgcggtggtcgaccacgggcggtacgcgtggcgtgccgaccggcccgggcgcgggctgccgggcgcggtgctgtacgagctgcacgtgggcacgtacacgcgggagggcacgctggacgcggccgccgagcggctcgggcatctcgtggaactgggcgtgacccatgtggagctgatgccgctgtgcccgttccccggccggcacggctgggggtacgagggcgtctccctgtgggcggtgcacgagccgtacggcgggcccgaggcactgaagcggttcgtcgaccgggcgcacgagctcggcctgggcgtcgtcctcgacgtcgtgcacaaccatctgggcccgtccggcaactgtctgcccgcgttcgggccgtacttcacggacacccatcacacgccgtggggcgccgccgtgaacctggacgcgcccggctcggacgaggtgcgcgcctatctggtcggcagcgcgctggcctggctgcgggactaccgggtcgacgggctgcgcctggacgcggtgcacgcgctgtgcgacacgcgcgcgtgccacttcctggaggagctgtcgacggcggtggacgccctcgctgccgaccaggaccggccgctcttcctggtcgccgagtccgacctgaacgacccgcggctcgtcactccccggcacgagggcggcctcggtctgcacgcgcagtggaacgacgacttccaccacgccctgcacaccgcgctgacgggcgagtcgcagggctactacgaggacttcgcccgggcccccttcgcggcactggcgaagacgctgacgggcggcttcttccacgacggcacgtactcgacgttccggggccggtgccacggccgcccgctggaccgtacgcgcgtgtccgcgcaccggctgctcggctatgcgcagacccacgaccaggtcggcaaccgcgcccagggagaccgtctttcggcgtccctgtcccccgggctgctggcatgcgcggcgacgctgacgctcacctccgccttcacgccgatgctgttcatgggcgaggagtgggccgcgggcaccccctggcagttcttcaccgaccacaccgatcccgaactcgcggaggccgtacgccggggcaggcggcgggagttcgcggcgcacgggtgggccgaggaggacgtccccgacccgcaggacccggcgacccgcgaccgctcctgcctcgactgggcggaaccggaaagcggcatccacgcgcgcgtgctggcctggtaccgcggcctgatcaccctgcgccaccacgaggcggacctctcggaccccgacctcaccgacgtcaaggtcgcgtacgacgaggaggcgcggtggatcgccttccgccgcggcgacgtacgcgtggccgtcaatctgtccaaggagcccgcgcggatcccgctcggtctcgcccacgcgcgcgtgctggccgcgtgggagccggtggagaccccgggcgcggacggggtactggagctgccgggcgagtcgtcggtggtgctcacgcaggcgtgacgggcggtggcgggtgggttggggcggcgcgtatgcgcttgcgtaaacgcttgcgcaagcgtttacgcatcgtccgtcacgtcacctctcgccgccccgccggacaggtctagagcgtctcgtcccccggcagttccgtgacccgttccaggaggatcgcctcccaggcgcgccgcagtcgggtgcgcagaagcgggagggggctgtcgtcgcgtccctggagacggtcggcgaggcggacgagggtgtcgcagcgggtgagccacaggccgcgcagacaggggcgggcgccgtagccggcgagggtggcggcacgtacggcggcgggggcgcccacggcgatggccagcccggcgatgtcctcggcggggtcgccgatcaccgcgtcggtccagtcgaggacgccgcgcacccggccgtcgccgctcaccacgaggtgttcgcccttgagggcgtggtgcacgaggaccgccgcaccgggctgcgcggcgagctgcaccgccgccggcgccgtgagctgaccgaggcggtccgcgtcgaactcgtcggccccggagaggtactgggcggcgtcctccgcgaccgtccgcagcgcttcgagggaacgcggcaccgcgcgcgggacgccgagcggctccgcctgtcgtacgggcacctcgcgcaacccggtgagcagcgccgcgaggtccgcctcaccgaccgccgagacggcatgctcctctccgccggcgccgggcagcctggtgtcgagggtgtaggccagccccgtggcccactcgccgtgcgcgacgctcgccgggaccgcgaccccgatgtgcggccggaccaggtcgcgcagccgcagctcgcgacgcaggcgtacggacgcgtcacggtcgggggcgagccgcagcacatggcgcgtaccgacccaccaggtggagtgctcaccgcccgcggcgacgggccgcacctccggtcccgctccgtccgcggggccgtcggcgagcacggaacggaccagtctgcggatgctgtccgccgtcggtgtcggtgcctgggtcatggtcgcgccgttgtcgtctcgggggcgtgaggggggtggtcggtcagtcgacgatcaccagctcgcgggaggtgttgttgaggcggcgtccgccgtcgtcggtcaccgtcacgatgtcctcgatgcgtacgccgaagcggccgggcagatagacgcccggctccacggagaagcacatcccgggtacgagggcccgctgttcgccctcgatcatgtacggcggctcgtgcgtggtgacgccgatgccgtggcccgtgcggtggatgaagcggtcgccgtagccggcgtcggcgatgaccgcgcgggcggcccggtccacgtcctggcaggcgacgcccggtcgcaccgcgcggaagcccgcctcctgggccgcgcgcaccaggtcgtgcaccttgcgctcctcctcgtcgggctcgccgacgtggaccgtgcgcgaggtgtcggagccgtagccgtgcttgagcccgccgaagtcgaggacgaccatgtcgccgcgctcgatgacgcggtcgcccgcctcgtggtgcggattggctccgttcgggccggagccgaccaccgtgaagtcgacctgggagtgcccgaactgccgtagcagttcggcgagatcggcggcgacgtccgtctcacggcgcccggcgaagggaaccttccggatctcctcgaacgtggcgtccgcggccgcgccggcggccgccagccgctccagttccgcggcgtccttgacggcccgcagcatcggcagcgcctcggtgagcgcgacgtagcgcgtgccgggcagccggccgctcaggccgagcaggtgcatggcccaggcgttgtcgctgatgccgaagcggccggaccggtcgaggagggtcgcggccgcctcgtacgggtccttgccgtcggtccagtcgcgcagcgtcagcgcgggcgcgccggccgcctccgccgcgtcgggcgcctccagggtgggcacgaccaggacggggtcgtgtccggcccgcagcaccagcagggtgagccgctcggtctcgaccggccggtaccccgtcagccacaccaggtccgggccgggtgcgaccagtacgccgtcgagaccggcgtccgcggcggactgtgccgcgcgccgcatccgggccgcgtagtcggcggcggtgaagggtgcggggtcgccggtgccggggggcgcgggcgtgccggtcatccatggcctccgtaggtcgcggtgtcccagggtctacgggcagcatcctccccctccgacggggcgtgcgcgagccgattgcggtgccggggtcgacttcccgagacaatatgagagtgcctctcacattttacgaaagggtgccttcacggcccgcgacggcgaccggctgccgacacacgtcggggcggctccgccggtgaccggacggcacccgcggcatccggcgggttcgggctggtccgtggcgccgaggctcgacgggcgaaaagggccggtcggccgcacgagtgccgtccgagcagtcggtcgcccgctccgccgccctgccgcgccgcagggcagccgagaccgaaccggggctccgccccgatggtgcgggctcgcgtcgtcgtgccggccggcggcggccgtccggcatctccgggctcgcggggcatgatgcggcagccgacgccgtggctacgtacgagccccccgcgacgagtagcggttgacgagtcacctccccgtcgcggctacgtgacgatccccggtgtcgccatcaactgctgctggttgccgttggcgtgacgcaccgtcagtgggactgccgtgccggggcgtgcgcctgccaccgcccgggcgagatcggcggccgagtcgagacgggttctgccgaaggcgagcaggatgtcgccgcggaccaggcccgccgtgtagcccggaccgggggcatggacccccaccacgagagcgccattggacgcggcgtccacggcttcgacgcccagggtcgccttgcccggcgcgagcacggcgttcgcactgctgtcgccctgcgcggacttggcgcccatggactgcggtccgccggacaccgacgcccccggacggccggaggccggcggaaccagaggacccgacggccccgccgctcccgcaccgcctcccgcctccgctgcaaatccgccagcttgctatccgatcacggtcgcgcccacggtgccgaggccgatgcccgacagaacgaggaccgtcccgacgaacacggcgaagagcagggtcgtcagccgcttgccccgtcggggcggagcggcatgggggcgccggggggtgccggacgctcgatcgccaccggactcctggcccggcatcggtttgggacgcaacgcagtctgttccatggatcgcctccacagatgctctaccccgcgcgtcggcgcaccacgatccacgaacgagtgagactgggcccgcgtcacctcgacaccctggcgggcgccggcggcgcgggccgcggtccggcatcccgcgcagccgcaccccaaggccacccgtccccctccggatcgggcacacccgacacctgactgcgcccctcgccgacgagccgcagccgcctgtcccccccctcagcgcgccaccggcgccgcccacgcggtgaacggtgcggaaggtgcccggtccggtacgaagccatgggcacgccgggccaggtccgccgcgccgtagcggtggcagtcctggtgccacttcaggatgccggacatccagttctgcaactccacgacatagccgtccatgatgtcccgcacctcctgcgggagcttgaagtccttgtagaggagcggcagttcatgggcggccacgtgctcgaactggtgcatccgctgggtcatcaggtcgttgatgacgccgagcgcggtcgggtagtcgcagccgaagaagttctgcacgacgaggatcgcgttgtgcacctcgccctcgtactcgatctccttctggtacgagaagacgtcgttgatgagcatgccgtagtcgacggccgcgttctccagagagcggacggggccgctgcggtagatctcgggcgggaccttcgggccgtggcccacgcggcacaggctcagggtgaggtcggccccgaaggtggcgcggcgcatctccaggtagtcgatcgggtcggggatgcggtgctggagctggttggacagctcccacacccagctctcggtcatcacgtccaccgaggcgcggaacgtgcgccgctcgtccggggtcatctccgccgtcgtaatggcccacaggtcgatgaggccgcgctccatgccgttgaccggcgccgggacctcctcgccgtcgaccggcatgcacgccgacagccgtcgtgtgcacagcttggcggccgcgaggtcgcggcgcggcccgaacaccatcgggtagtagtcgtcgccgtacgtgccccaggccagccaccgtgagctgaggtcgagttcgtcgggcgtggcgtccggatcgaggccggccgagcacagcggcaggtcgtacgccgtcagcttgtcctcgtcccagacgccctcctggagcatgcccgtgctgtgcatccacggggtcagccgggcgcgggcgccctccaggtgcgggctgagttccacctggaacggcatatggaagtcggggatccgggacggtccgaccttctggaacggcacgtgggtgtatcggcgcagccgctcggccccggcgtcggcgagcagtccgcgcaggtcggcggcggaggtgccgatcgcggagagcccgaagggccgcttctgggagagggcgccctcgttcatgtagcggctggacctcagatgccattcgtggccgcccgactgccagtcctgaagtccccgcgcgtacgccgcgaccgccgcgacctcgggtggggtgaggcctttctccagggccagcgcgggcacttcggtgagcgccgtgtgctcgaactggtggagccgcgaggtgaggatgtcgttgacggtctcggcggcctcctgcgtcgtacagccgaagaaggtctccaggacgaggacgccgttgctcagctcaccctcctcctcgacctcccgctggtacgagaacaggtcgttgcgcaggtgcaccccgtcggagaaggtctccatcagcacccgcagcggcctcgacccggcgacggcggccggcacttcggcggtcgcgtactcgacgagccccgccgaccagggggctccgccgaccttgcggcgcatctcgatgtactcgacggggttggcgatccgcccctcgttgatgttggacagctcccacagcgactcgttgagcaggtgctcggtcgagacggcgaaccgcttgcgccagtccgccgacatcgcgggcaccgtgcgcgcccacaggtcggcgaggcccgcctcgaccggattctccggctccggaacgggtgccgacaggtcgagcggcatgaagagcggcagccggtccagataggccttgccgccctcgcggtcctgggtgcgcttgaacgtctccaggaagtggtcgtcgaagaagaacacccacacgtaccagtcggtgatgagcgagagcgccgggccgtcgcagtcggggtgtgtgtacgcgcacagcagcccgtagtcgtgtgcgtcgaggtcggactgctcccagatgccggagccctccagcatgcccatgccgcgcgcccaccgcgtggagtgggcgcgcgcctcgtcgagatgcgggttcagccgcgcggggtagggcatgtagaagtgcgggagttggaacggctgcgtcatggccgggccctacccagggcccttcggggacatccgcgggccgggacatgatcacaccatcgcgtgaatcgcgggcgttcccgcccggccgtcccacgcgtgcgtgccccggttccacgcctgcccgccgcagttccgcgcctgcctgccccggtgccacgccctcttgccacccctgcccggccgggtcaccgtgacagcatgacctccttcgtgctgccccatgaactgcacggcgacggcgcccacaaggtgttcgcggtgcacggctggttcgccgaccgggccgcgtacgcggcggtgctgccggatctcgaccgggccgcgttcacgtacgcgctggtggatctgcgcgggtacggaagggccaaggacgcggtcggcgcgttcaccaccgccgaggccgccgcggacctcgtcgagctggccgaccggctcggctgggatcggttctccgtgatcgggcactccatgggcggcacggtcgcgcagcggctgctggccctcgccccgaagcgcctgcgccggatcgcgggggtgtccccggtgcccgcgtcggggctgtcgttgccggccgaccagtggcagctgttcgcggacgcggcgcacaagccggagaaccggcgcgcgatcatcgacgtcaccaccggcgggcgccgccccggggcctggctcgaccggatggtcgcccgctccctcgcggacagcgacgcgaaggcgttccgggcgtggctggactcgtgggccggggaggacttccaggcggaggtcacgggcgcgggggtgcccgcgctggcggtgacgggggctcttgacccggcgctgtcgagcgcgctgctccgggacacctggatgcgctggtacccgcgcggcgagctgagggagctgccctcggccgggcactacgccatggacgaggcgccgctcgacctgatccacgtggtggaggagttcctccgggccgaggacgccggcgagtgagcgtccgcgagcaggccccgcccgtccccgatgtcttcgacccgcgccggtacgccgccggagtcccgcacgccgcgtaccgcacgctccgcgaccatcaccccgtcgcccggcaggccgagcccgaggtgctcggctggcccgccgggccggggttctgggcggtcacccggcacgcggacgtcgtacgcgtgctcaaggactccaccacgtactcctcgcggttcggcgccacccagatccgcgaccccgatcccgacgacctgccgttcatccgggacatgatgctcaatcaggatccgccggaccacggcaggttgaggcggctggtcagccgtgcgttcacgccgcgccgcgtcgaccggttcgagtcgctcgcccgtgaccgcgcccgcaccctgctcgccgccgccctcgcgggtgcgcgcgccggcgacggcagctgcgacctggtcgccaccgtcaccgacgactacgccctgctcaacctcgccgatctgctcggtgtaccggagagcgaccgcggcctgctgctgcactggacgcggcgcgtcatcggctaccaggacccggacgaggcgggcgagccgctcctcgacgcggcgggcaaaccggtcgatccgcgctcaccgggggccctgcgggacatgttcgagtacgcgcggcagctggcctcgtacaagagggaacaccccgccgacgacatcatgacgaccctcgccaccgaccccgaactcaccggccccgagctggcgatgttcttcttcctgctgacggtcgcgggcaacgacaccgtgcgcggcgccgctccgggcggcctgctggccctggcggagcacccggaggcgtacgcccgactccgtgcccggccacagcaactaccctccgccgtagaggagttgctgcgctggcatccgcccgtgctcaccttccgccggacggccgtacgcgacaccgacctcgccggacagcgcatccgggccggcgacaaggtcgtcgtcttccacgcctcggccaaccgtgacgggcgcgtcttcaccgccccggaccggctggatctgtcgcggtcaccgaacccgcacgtctccttcggcgacggcccgcatgtctgcctgggcgcgcacttcgcccgcctgcaactgcgggtgctgtacgcgcagacgctacgggcgctgcccgcaccgcgggtcgccgggcctcccggacgcctcgtgtcgaacttcatcaacgggatcaagtcgctgccgttgcaggtggcatgaggggtgcgtcagggcctggcctggatcaccgcgtgcgtcccgctcgtgcgccatccctgcccctgggccgccgccaacgccgcctccgtgtccgcgtccaggccgacgatcacgtccgatttgagggtgcgcagggccacgaccgggccggggaagtacgccgtcggggtggtgaacggtgtcgtcgggggccagagccggtcgcccaccagacggcggtagttgaggtcgcccttcatgatggtcaggtccgcctcggcgaactcgcggcgcaggtcgtccggcatgtccgcgtacggcagcggcgcacaggagaagacatgggcccgcaccacgaggcggccgtcggtcagggccgaccacaggcggtccccggccgccccggccgcccccttggtgccggtcagccgccgtaccgcgtccaggacgtcggcggtcgtggcgtccgagacgaagtacgggtacggcttcacgtgcagcaccgcccgttcggcccgcccgtggtgcaggagatggtcgatcaggagcaggtccgggatgagctcgcggccggcgttgtccgcgaccagacagaccgtgcgggccgggccggccgtgccgtcggcgtcggagtcggagtcggagtcggagtcggccgtgtgcgccggcagcagcgcccacagtgactcgctgtcgtccacgaggagttgggagtcgacggagccgtcgcccccggcggagatgcggaagccgaggtccgcgcggttgccccagagcgagccgtggagcagcgcccgcgcctgttcgtccagcggccgtccggtgagcgcgtcgagcgcggccagttcctcggccgcctccggggtgtcgagttcggcgagcttgaaggggcggaaggggtcgatgccctgccagggccctgagccgaagtagccgacagccgcgaggagttgtcggtagaagtagctctcggcccacaggaagggcaccgagaaccaggagcggccgaggtgcttcggaagcccccaggccacccaccgctcgtggtcctcggccggtgtgccgagcggctcgatcacaccgtcgagggcgctcttttgcagcgcgtcgagcgcgcgccgctgctcgggcccgtacgggaaggcgtcccgcaccttgcggatgagcgcggggtgccgctcggccagcacgctgtgcgggaaggatcccgggtcgtcgctgacgatcacgggggcttcagacatggtcctgtgctccttcgggaccggtccggatgccgacaggcagctccaggtccctgaccgcggggtccagctgcttcccgtatccggcctcggtccacacgtacttctggaactgctccggcgtcagcagaccctcccacgggccgccgccggggcagaacaccgacgcgcacccggagcagtagtgcgccggacgccacagccggtcggcgcggtgctctccggcgttcaccacgtcgcgctcgcgcgcctcgccgcggaccacgaggatcgtgccgacgaacagcagcacggccagcagcgctccgccgatcgtgtagagcggcttgtcgttgtccaccccgctgtacgcgagcgcggcgcccacgccgaccatcagcatgccctcgacgaagtgcagacagccgtcgaatcccgacgtcacgcccggcgccttcgccaggcggttggacaggccgtcgcgcacggacgcctcgtcggcgcagatctcctcgaccgcgcgcaccgtcgattcgccgcagctcggacatatcactccgactggcccgtgggccgactcagttggcatgcgcatacgctaacggccggccggcgcacacgctgtcgcgcgggccggtgtcccgcgccgccacaccctggacgcgcagcttccgggtgccgctcgcggtggactgaacgcacggcatcgcatccccgtactcctctggtacgcgctcccccaccggccgaggagactcccggatgaccgcacaccgcaccgccgccgcggccgccgtagccgtggcggccccgctgctgctgaccgcctgggcggcgggtccggcccaggcccatggcgcaccgacggatccggtcagccgggtggtggcgtgctcccccgagggcggcggccgggcgcggaccgccgcctgcacggcggcgatcgcggccaacggctcgcccttcaccgcgtgggacaacctccgggtcgccggcgtgaacggcagggaccggcagctgatcccggacgggaagctgtgcagcggcggcctgcccgcctacaaggggctcgacctcacgcgctccgactggccgtcgacacggctgacccccggcgcgtcgctgaccatgaagtacagctcgacgattccgcacaccggcacgttcaagctgtatctgacgaaacaggggtacgaccccacgaagccgctgacctggtcggacctgccggcgcagccgttcgcgcagctcaaggacccggcactggcgggcggcgcctaccgcctcggggcgaagctgcccgcggaccggaccgggcgccatgtgctcttcaccatctggcagaacaccagcacgacggacacgtactactcgtgctcggacgtggtcttcgcgaaggccaaggccgccgccggtgcgggcggcggatcgacgggcgccgccaggaagccggccggcaaggcgactccgagcagtcccgccgccacgtcctcaccgtcgagctccccgtccccgagcaggtccgagaccgccgcctccacgccgccgccgtccaggaccgccgtgccgggtactccggcggcggccaccgcgcaccgttccgacagcggcccgtccctgcccctgctcgcgggcggcgccgcggcggtggtgctcgccgcgggcgccgtcgtgagcttgcgccgccgtcgccgctaggaggtcgccgccaggggacggacaccccgtgtggggcgtctcctggcggcggcccgcgggccgccgccaggccgtcgccggacccttgccgtcagaccgtcgtcatcaggccgtcgccgtcaggccgtcgtcagttgacgaagaccgacgggctgccggacacgctggtgtccttgaccggggcgtacttcgcggtgaagtagccactgctgaagcacagggacgagcccgaggtcttggtgaactgctggttggtgaaggtgatgctgttgtcggtgttgctcgccgtgcccgacaggctgggggcctggtagacacagttgatggtgcccagcagggtgctgagcttgacggtggtctggatggtggagccgctggccggagtcacggtgacggttccgtcggagcccacggtggtggtgtacggaaggttgttgacggtgacgccgctgacgccgaggacaccgatgacattgctggtgcaaccgtcgaaggtgtgcgcggtgaccgactcggtggccgtgccggacgcggccgggttgtccacgacaccggcggtgaaggtggacgcgctgcaggagacgccgctcgtgccggtcgcgctggagtagagcgtggccgcggtgccggtggccagcgaggcgctgagcacgtcaccggtggcgacggcgtcaccgccggcgctgccggtggtcaggaccgtgcctgccgcggaggcgggcgacatcgccgagaccgagagggccacgacgacgccggcgagggcaagcaagggtcgagtgcgcatgggggtgcctcttctcagaagtgtggagctgctgcgggtgaccgcgcccctcggggatgcgaggggacgcggaggtgcggctgccgccgccggcccatggcgccttctccgtacgcgacggaccggcggcggcagccgggcgaccggacacggcccaggcgatgggaaggcgaccgtgccggcgccgcggtgggggtgatggatcactcggaggtggtggagaccgcgcatcgtggtggagaccgcgcatcgtggtggagaccgcgcatcgtggtggagaccgcgcatcgtggtggagaccgcgcatcgtggtggagaccgcgcatcgtggtggagaccgcgcatcgtggtggagaccgtgcgtcgcgccgcgcgtccagaagtgccgccaccgccccgggacagccaggggccgggagagcgactcgcgccgtgcgacggatccggcgccacggatccttgggaaagcaggggaatttgtaaacctgatgagcagtcaacgtcaagacgtagcaaggaagttggcggctcgcggcggagaagttgacctgcggtacacctggtgacgcacaggtgtcacacaaccatcacccttttcgcacaagttgcttgaccctgaactgtaaccaccggtaacttccaccgcggctactgctgcgtaacgagaaagcccttgcgctcgccgggaggtgcgaggaggcgtccgcggcagccgctgtccgcgccaggacaacgtgccagtgaaaccgcacctgcattgactatgcccaggagcagacatggcctcatcctcggacgccacggcgtcccacggttccaccccccagaccccggaaagcggttccgccgccgaagggtccgaaagacgcgggcgggtccgcctgcgccgcgccgcggtgatggcggtgcctgccaccgcgatcgccgccggactggtgatcctcaccgcccagggtgccctcggggtgcagttcgccatatccggcatgccgttcacggtcaccgccaccgacctgaacggcaccggcttcgagcagttcggcaacctcgacaacatggccgagggcagcccgaacgccggtgacaccggcggccaggtcctggtcgtcacctccgcgatcaaggacgcgaccctcaccaagctgtgccagagcgtcgacctcggcggtacgaacctgcggatcgaggcgggcgccggcaaggacaaggtggtggcgagcgatctgaccaccgactccaccgagctgtccggcgacgccgagttcaacaagatcgagatcggcaacgacgcgagcacgctcgacaaggcgggggtgcagggcaacaagggcgtcttcagccagcaggccgacaccgtgcatatcgccaatctccggcagaccaactacgcgaccacggcgggggtgttcaagcttccgggcctgcacctcagcttcagcgacaaggcctgctgatggcatcgcggccgaggtccgccttcaggcggtggcgcgcgagccgtcccttctggggcggactgctgctcaccctgggcggtgcggaggtcctcctcaccgagaaggtgtcactgaaggtggtcatgcacatcggcatgcagggcctcgcgggctatctgctgccggtcgtcatgatgctgtgcggcctgctgatcctcttcaaccccgcccagcggctcttctactccgtcatcggcatcctggtgaccctgggcacctggctcacgtccaacctgggcggcttcttcatcggcctcctgctgggcgccacgggcagctgcctcgccttcggctggctgccggaccaggaaccccgccggcgcctgctgcgccgccatcggacgccgtcccccacggccgattcgcccgcgtcctgacgccaccgctcctcggcgagcgggctccgccgaccgccccccgcggcaccccgaggtcgtccccaccggaacccgctcgccgagcccgtggccatgggccggggccccggcggtcgtgtggtcgtccggcccgcggcctcgccgccaagagcgcggcgcgcagacgcgccggtacagcgacggtgcagcgacggtacggccacatgacacgtacggcgtccgccggcgtccggcgggcagggcccgcacctagtcgccgccaggggccgcatccaccgcggggcactgaccccagggacggtggtactcagcgcttcgtgcgggcggtcaccgtgaagcgggccccgtcggggtcgctcagcaccgcctccgtggcgccgggctcccaccgcagcaccgtgccgccgtggtcctgggcggcatggacgcaggcctcgacgtcgtcgaccgcgaagtggacctgccagtgcggtctgagctgggggtcgggcgcggctcccaccgccccggagtggatccgcgccaccacgtcgccctggctgagcagtacgacctccttcccgtcgtactggacctgacaggcgccggggcgtgcggaggcccattcgaggacctccccgtagaagatggcggcgtcgaaggcgtcgcgggtgtggaggcgtacgaaggcgggggccgcgcggcgccagtggtcccagccggcgacgagctgtccctcccagatgccgaagacggcaccgtcgcggtccgccagcagggccgcccggccgggcgggaaggcgatcggcccgaccgcggtcgtaccgccgcgctcctgactgcgggacacggcctcgtccgcgctgggcaccgcgaaatacggcgtccaggcggccgccatctgccactgcgaggccaccgcggcgatcccggcgacgggcatgccctccgacagcgcgaagcggaaccggtcgccgagcttgcccgtgcgccagcgccagcccagtaccgccttgtagaagttctccgcggcttccaggtcgcgggtggtgaggctgacccagcacggagcgccgaacaccgaatggctggagacgatctctcgcgcgagcgttccgtttcttttcatcgctctaccgtcctgtcatctccgccgccgctccgcaacccggaggcccccgagaggccccgtagtcccggccccgggtaccccgcggacatcggggcaaactccacagaccggcacggctcacggccgccgcagggccgtactcagctcacggccgccgcaggaccgggctcagctcacggcgcccagcgaccagctcgggctgattccggcgagccggcagatgaggaagtacagcgggatcggtggcgtgtacggagagtcaccatcgggacggtggatgaggcggggaccgccggggcgggggcggcccgatgcccgggtccaggacgggtcggccagataggccccgatcgcgtaggtcgtgcaggacggccaggtgacgcccacgtgggagccggaggggacgatccaccaccagcgcaggtcgtcggcgaagacacagccgacgcgcgggaggcactccatgatccgctcgccgtgctccggcgaggtgcccacggcgtcgtagccgaggccggccggcagttccacggggagggagagccgctgggggcgctcgcacagcagcggggcggacaggccggggcggggatcggacaggcgccggtgagcgtcggacaagcgcgggcgagggtcaggcgtgtgctgtcggtccatgggatgacggtccttcggccaggtgggggacgggccgggtggtgttcgtggtcgccggaagcccggtcgaggcggggtctcctccgtccggcgacagctcggcccagacgatgtgtccgggcccgtacgcgctgttcttgacgccccagtcgccgctcagcgcgccgaccagcaggagtccgcgacccccctggtcgtcgggctccggccggcactgggcggggagggtctggccccggtgctcgtcctccacctcgatgcgcacccgcgcgccgtcggtgcgcagtctgcacacgatccggccgctggcggtatgcatgatcgcgttggtgacgagctcggaggccaccaggacagcgttgtcacatgtctcggcgtcggtgttccaggcggcgagcagctcgcgcacatggccgcgggccacggccaccgaggcggggatcgcgggaaggccgaagatgcccgcctgggggacgggctgctcctcccgcgccggtcgtcccggtcgtcgtaaaggctgggggagggagggcggagccatcgccgttcgcctttcatctgccgtcgcaccacggaaggtgccggtgccacaccgctcagtgccgtcgcgagtcgcgcaccagcggccaactcgcttcgaatcgtgcccaagagcagccctgactcccccaactggactgctcagcatcctcgttcaccggctcctgacggtggaaccactctggcacctgcgaacgacgcctcgcaaccggcaagttgaaaattgcaatgtgtgaggtgcatgctgcctccgccggaagatgatcgtgacagactgtgacccatgacccgtgactcggtgtgagggggtagggcgtgaccgcggagaccgactggggcggcgcccccaccgtgctgcgcatgatcctcggcagacagctcgaggagctgcgcacccgggccggccgcacctacgaggaagcggccgcggcgatcggggtcagccactccacgatccgccggatggaatccgccaaggtggcccggctcaggctcgcggacgtcgagaaactgctccagatctacggtgtgacggaccagcaggagatcgacacgttcctgaagtcggtccgtgaggccaacaagcgcggctggtggcacacctaccgcgatgtgctgccggactggttcgccgcgtatctgagcctggagcaggcggcgctccagatccgggcgtacgaggcgcagttcgtccacggtctgctccagacggaggagtacgcgcgggccctgctgagcgccggaaacccgcacgccccggccgaggcgaccgagcgccgggtcgccctgcgcatgcgccgccaggaactgctgtcccgctctgcgccgccccgcctgtgggtggtgatggacgagaccgtgctgcgctggccggtcgggggccccaccgtgatgcgcgcccagatcgaccacctgatcgcgctcaacgcgctgccgcatgtgaccttgcagatcatgccgttccgaagcggtccgcatcccgcgatgcgggccggagcgttccacgtcttccggttcagggcacgtgagttgccggacatcgtctatctgagcggcctggtgggcgctgtctatctggacaagagcgacgatgtcgtggtgtatcgcgaggccctggaccggctgggcgcccagtcggcgcccgccaggaagaccgaggctctcctcggcgcgatacgcaaggagctgtgagtgcaccaccacatacgcgacggccacatacgcaacggcatgccggcccgggatctcggcgcgcgcggctggtccaaaccgtggagcgacgacgcgggaggcgcctgcctggaggcgaagaagctcgccgacggccgggtggcgctgcgtcagtccaccgacccggacagcccggccctggtcctcacccccgccgaggtggctggcttcctcgcgggtgtgaagaagggcgaagccgacttcctcctttgatttctcttaacttctctggtgacttctctggttctcctgcctggtcccctgtttttccatgaacgttcttacggaacctacgacttgaatgggaggggcggcgttgcccgacaacggatggccggccgaccgtatcgacaccgagagtgcgcactccgcgcgcatctacgactacatcatcggcggaaaagactactacccggccgacaaggaggcgggtgacgccatgtcccgggagtggcccgcactcccggtccacatgcgggccaaccgcgactggatgaaccgcgcggtggcccatctggcgaaggaggccgggatacgccagttcctggacatcggaaccggcatccccacctcgcccaacctccacgagatcgcccagtcggtggcccccgagtcccgggtcgtgtacgtggacaacgacccgatcgtcctcaccctctcccagggcctgctggccagcacccccgagggcaggaccgcgtacgtcgaggcggacatgctcgacccggcgagcatcctggatgccccggagctgcgcgacaccttggatctgacccggccggtcgccctgacggtgatcgcgatcgtccacttcgtgctggacgaggacgacgcggtgggcatcgtccgccgcctcctggagcctctcccctcgggcagctatctggccatgtccatcggcaccgccgagttcgcgccgcaggaggtgggccgggtcgcccgcgagtacgccgcccgcaacatgcccatgcggctgcgcacgcacgcggaggccgaggagttcttcgaaggcctggagctggtggagccgggcatcgtccaggtgcacaagtggcacccggacgccgccaccgccgacggcatccgggacgaggacatcgcgatgtacggagcggtggcccgcaagccgtgacccgccgctgcaagccgtgacccgcagaccgtgagccgcggcaagccgtgagccgcgtctgccgccggggcccgttcgaacgggtcccggcggcagcgacggacgtcagtccaggccggccgacgtcagccaggccttggcgacgtccagcgggtccttgttctggagctgcacctcggcgtccatcttcagcagtgccaccgtgtcgagcttggcggagaccgcgttcagcgtgtcggcgcccttctgggagagccccgacttgtagaccagcggctgcacgttctcgaacccgaagaggttcttcgggtcctggaggaccacgaacttctccttggtgatggtcgggtccgtggtgaagaggtccgcggcctgcaccgtgttcttcttcagcgccgcctgggtcagcgagccaccggcgtccagggccttgaacgacttgaagttcagcccgtacacggacttcaggcccaccaggccctgctgtcgggtctggaactccggagaggcaccgatggccaggtcgggggcgatgtccttgaggtccgcgatgctggactcggaggtgaggtggtacttcttggcggtggcggcgttgacggtgacggagtccttgtcctgcgcgggcgccgggtcgagcagcttcagcttcgagtcgagcttggcgttgatcgcggcggtcgtggtggcgaccgtcttcggcgtggccttggagtccaggtaggcgaggagcgcgccgttgtactccggcagcacggtgagagagccgttcttgagcagaccgtaagtggtctcgcggctgccgatgttcggcttgtaggtgaccttgatgcccttggccttcagggcctcgccgtagatgtcggcgatcaggatgctctcggcgaagttgttcgagccgacgacgacgctgtcgccgcccgccttgtcgcccgagagcgggtcggactcttcgccggaggacgacgaacaccccgcacatgccgccaggagcgccgccgtggcggcgagcgcgacggctgccgcgccggggtttctcgtccttgacctgctgctcttcgcggtagaagtcacaattcccgttccgggctcggatggtgtggggagcatggagatggcggggtgcgcggaagtccggcacctttgtctactgatccaatccagccggttctcggtcggtcaagaggattctggtcaccgattggcctcaatgcgtggccggttgtgaacgactggtggacgctctgccgatgagtcgcagacgctttgtaatggattcttgacgtggggtggccgaatcgggggtctgaagaggcggtagtctcgcccgagttggcgacaaggcacagcggcgtgcgggggccgccgtcttccgaacgttctgtcgcggccccagtcgatgaatacggtctcgtgaaccttcgcgcgccgtggtccgcccacgaaggaggctcggtgtccacgaacaaggtggacgcgccgacccggccggccccgtcgccgaacccgggcggcaccggcggtttcgccgcccgctggccgttcaggcgcaagctcaacgccctcgtcggcgtaccgctggccgtggtcgccgcgttgctctgctacctcatcaccgaccaggtggaccaggcgcgcagcgcggccgccgccgcccaactggtccgcgacagcgcgcaggtcgccgacctcgtcgaccgggtggagaacgagcaccagcaggccgtcctgctctccgtgcgctacgaggccgccgccggcgccgacgcccggcccgcgctcacctcctaccgcagggcccaggccgccgtggacgcgcaggtcgacaaggtgcgcggcacgttcggcgaccggctgcccgacacggaggcgcaggccctcaaggagatcaacggcctgggcagcctgcgcggcaccatcgaggagggctacctgcccgccgacaacatcgacccggcctacaccaacgccgccaaggggctgctcgacggcctcggactcgaccgcaacgccgccctcgccgccaccttcaccggcaatctgctggactccctgctgcgcgccgacgccgcccacagctccttcgagaccagcgtgttctcggcgacgaccggtgactccaacgcgctcatcgagttcaccaacgccgtgggctcctacgagctgtacacgtaccaggcggaccgcttcgcccggttcgccaccgagcggcaggcggacgaactctccgggatcgagcacagcacggcgcagcgggagatcgccgaggcgtacgccgagctccagatcgaccccagcggactccaggcgaacacgccgtcccggatccgcgcggcgttcgcggacgccctgcgcgactacccggcttatccgaagcaggccgagagccggctgaagatcgccgcctcgctcatcggccagatcgccgaccgcgccgacgacgcgtccagcgaggcctggtggcgggccggtctgctgctggccgcggctctgctcggcttcgtcctgtggctcgccttctcggtggcggtccggcggtcggtcgtacggccggtggaggctctcaccgatgccgcgcaggaggtcttcgacatcaccagccgggaactcgcccgggtggccgacgacgacgccgaggacctgggcccgctccggctgcgcgaggtgcccgtccccgtacgggacgagatcggcgaactcgccgaggccttcaaccacgtgcagtccaccgcggccgccctgctggagcgccaggtgctcagccgtcgcaacgtcgccgagatgttcggcaacgtcggccgccgggtcagcaacctcaccacacggcagctcgccctcatcgacgccgtcgaacgcggcgagaccgaccccgcgctgctcgaccggctgtaccgcatcgaccacatcgcggtccggctgcggcgcaacgccgacagcctcatgctgctggccggcatccgcgagaccgtgctggactccggccccaccgcgctcaccaacgtggtgcgcgccgcgctcggccagatcgagggctatcagcgcgtccggctgcgcgccgagaccgaggtcatggtggagcccgacatcatcggcgacctgacgctgatggtggccgaactcctggagaacgccgtcgcgttctcgcccgtgggcagccccgtcgaggtggcggtgcgcgggaccggtggcgacggcgcgctgatcgagatcgccgaccacggtctgggcatgagcgccgagcgcctcgacgaggagaacgcccggttgatccgccgcgagcgcctggacctggtgccgaccaaggtgctcggcctcttcgtggtcggcagcctcgcccggcgctgggacgtcggggtgacgctgtcccgcacccccggcggcggtgtcacggccgaggccgtcatcccgtccacactgctgctggcgatgagcccgctcaacgtcccggccgcggtggcaacagccccggccgctgccaccgtcgaaccggggcccgccactccttcctcgcccgccacctcgtcctcgtccgccgccgccaccctgccccggcacggcgagaccgagtcccggccgggcgcgctgccccggcgggtgccccggcgcgagacggcgcccgcggagaaggcggaggagacggaggacagggaggaggcggaggagacagcctcgggcacggcgccggcgctccaggaccgcaccgagcggacgctcctcccccacgacgacaccggcgcggcccgcccgctgcgccgccgggtccgcggggccaccctccgcaccacggccgccgaggccgcccagcaggcggcgcacggccccgcccggcccgccgacgcgcacgaggtccgctccgcgctcgaggagttcgaggccgccgtggagcgcgcacaccgggacagcgggaccggcaccccggccccggccccgcagccgacacccgaccagaactaccagaaccaccagagcgaccagagcgaccagcgtcatcagaaccaccagagtcatcagaaccacctcccggaaggagcggagcagtgagcacgtcgacaggtgacactccggcgggaggcaccacgcccgccgaactgcgcgccgcagcagccgacttcacgtggctcctcaaccgattcgcgaccgagaccgcgggcgtcgtcgacgccatcgccgtctcctccgacgggctgctcatcgccgtttccgagctgcgtgagcacgccgactccgaacggctggccgccatcgtctccggtatcaccagcctggccgccggagcctccggcaactacggcctgggcggcctcaacaaggtcatcatcgacctggagggcggccacgtcctggtctccgcgatcggcagcggcgcggtgctcggcgtggtcaccgacaaggaggccaagctcggcaacatcgcgtacgagatgacgctgttcgccaaccgggccggcgccgcgctcagcccccaactcgtgctcgaactgaagaactccgtcggcgtcacgtcgacggggtgaccggcaccgtccggtcgaggaaggacacagctcatggcggacggccgtactccggccggcgaggaccgcttcacggccccgggtcccgacccggtcggccccgcccccgccgtgcggccgttcctggtcaccgcgggccgggtggcgggcaccaggtccggcccgccgatcccggtcgagacccaggtggtggccaccgccgagggtctcgaccagctcgaccggctctcgttcgagcagcacgacatcgttgccgcgtgccggcagccgcagtccatcgcggagctcgcggcccggctgcggctgcacctcaacgtggtccgcgtcctggccgaggacctgcgctccgaaggacggctgtcggtgtaccttccgaaccccggcatcacccaggacgcgtccgtactgcgaagggttatcgatggtctccgcgccatccccgactcccggggggtactccgtgacaccgactgaacaggccgccgtacggccgccgctgccggtcaagatggtgatcgcgggcggcttcggcgtgggcaagaccaccgccgtcggctcgatttccgagatcgtcccgctgaccaccgaggcggccatcaccgaggtcgcggcgggcgtcgacgacctcacccacaccccgcgcaagaccacgaccacggtcgccatggacttcggctgcatcaccatcgacccgacgctgaagctctatctgttcggtacgccggggcaggaccggttcgggttcatgtgggacgacctggtcgagggtgcggtcggcgggctcgtcatcgtcgacacgcggcggctcgacgactgctacgcggccgtcgactacttcgagcacaagcagatcccgttcgccgtcgccctcaacgccttcgacggcaggatcgagcatgatctcgacgaggtccgctgggcgctcgacgtcgccgagcgcgtccccgtcgtcgtcttcgacgcccgggaacgcggctcggtccgcgacgcgctgctcgtcgtactggaactggcgctggcccgcaccggggcatgacgcgccgcgggcccgggacgcaggatccgtcccgggcccgcccccacgtcgtcgtgctcagccgctcctgcgcaccccgggcgacacggcgacccggttgaccgtccagaacagcccgagggtgaccagggccatcacggccaccagcgtggctccgccgaccaccttctcgtagttgcgctggtagaggccgtccacgatgtagcgcccgaggccgccgaggctgacgtaggcggcgatggtggccgtcgagacgatctggatggccgccgacctgaggccgctcaggatcagcggcagcgccaccggcacctcgacctggaacaggatcttcgcctcgtgcatgcccaggccccgggcggcgtcgaccggcgacgggtcgacggagcgcatcgcctcgtaggtggtcaccaggatcggcggcacggcgagcacgaccagcgggatcatcacgggcagcagcccgaggccgagcaggacgaacatcagcaccagcaggccgaagctgggcagcgcccgggcggcggtggcgaggaacgcgagcgcgttgccgccacgcccggtgtgcccggtcagcagccccaccggcagcccgatcgcggcggcgatgccgagggccatcagcgagtactggatgtgctccaggagccggcgcgggatgccgtcgtagccgtgccagtgggcgctgtcgctgaagaaggcgttgatgaagtgcagtacgttcaccggaccgcgtccttaagggcgagcgcggccggttcgggccgggcggagtcgtcccgcggggcgcgccgtgccgagcgcgtgccgcgcggcatccagggcgtcagcaggacgcgtacgagtaccagcgcggcgtccatgaggatcgccaggaccgccgtggtgaccacggagttcaccgccagtgcgggccggtggtagaacatcgcgtcggcgagcaggttgcccagggcgccctggttgccgatcagggtgccgacgctgacgaggctgatgctggagacggtcgccacccgcagcccggcgatgatggcgggcaccgcgatcggcaactgcacctggacgtagcgccgtacggggccgaagcccatggcggtggcggccgcgagtgtctcctggggcaccgacctgacgccgtccacgatggccgggacgagcagcaccaggctgtacagggccagcgggatcatcacggtgatctcgctctggccggtgtagtcgatgaggacgacgaagaacgccagcgacgggatggcgtacaccacggtcgtcaccccgaggaccggcgggtacagccagcggaaccgcacgcacagctggccgagcggcagggcgatgaggaggccggccaggaccggcagcagggcctccttcaggtgcagtccgatgagcccgagatagctgtgctggaggtcgctggggatgtcgaagaagccgttcatccggcgaggtccgccttccgccgctcggcgtgggcgccgcggatggcctcgccgatcgtctcctgcgagacgaccccgaccacccgtccggtgccgtccacggcgacggcccagccggtgggcgagagcacggcgcagtccagggccgcgcgcagcgagtctttgccggactcgaagggccgaccgtacggcagcagccgttcgggcaccaccttcccggcggtgaggtccttcggctcgctccagccgagcgccttgccgtcgacgtcggtcacgaggaggtagggcacgtccggcgtgccgcgggcggcgatctgctcggcggtggagtcgatcgcgacgaccggagtggtcagcagctccagcccggcggaggggaagaacgaaaggcgccggatgccgcggtcggtgccgaggaagtcctccacgaaggcgtccgccggggcggacagcagttcggcgggcggcgcgaactgggccagatggccgccggtgcgcatgacggcgaccatcgtccccagccggatcgcctcgtcgatgtcgtgggtgacgaagacgatggtcttgcccaactcgtcctggatccgcaggagttcctcctgaagtcccttgcgcaccacggggtcgaccgcggagaagggctcgtccatcagcagcacgggcgggtccgaggccagggcccgggccacgccgacgcgctgctgctgtccgcccgacagctggtacgggtagcgcctggcgagtgaggcgtcgagccccacccgctccatcagctccctcgcccgcgaccgggcccgctccttgccccagcccagcatgcggggcacggtcgcgatgttgtcgacgatggtgcggtgctggaagagaccggcgttctggatgacgtaacccatggaccgtcgcagcgtgttcacgggttgcttcgtgatgtcggcaccgtcgaggaggatcgtgccctcgctgggctcgaccatcctgttgatcatccgcagggtcgtcgtcttcccgcagcccgacggccccacaaggacggtgatcgagcggtccggtatctccaacgacagccggtcgaccgccaccgttccgtccgggtaccgcttggtgactgaatctatccgtatcaaaacgccgaatacccttcgggtttggcagaagacgccgtttttcggccacggtcgatcgcgcaggccgttgcgggaagagtctagacggcccgcgtttcgcctcgtcggctacgtcaccgtccacttctggttgtcaccggtgccgcagctccacaggacgagcgaggtgccgttggccgtggcggcgttgtaggcgtccaggcagaggccggcgttgacgttggtgatcgtgccgtcgctgttgatgttccacttctggttggcctggccgttgcagtcccagatgacgaccttggtgccgttggtcgtaccgaggttgtaggcgtccaggcacttgttgccgtacagcaccagttccttgcgggaggtgtacgtccaggactggttggggccgccgttgcagtcccacaactcggcctgggtgccgttggtgatcgtgttgttgtagatgtcggcacagcggccggactgcttgccggtgaccagggcgccgttcgtgccgggcagcggccggacggtgattccctcggtggccgggccgcccgagagggcgagcgtgttggcggagcccttggagagggagacctcgacggagaccgtgcccgcactcgcgccggtcggcgggaaggagaccgtggtggcggtctggccgttgacctggagcgtggcggtgcgggccgagctcgtgttgttggtgtaggcgacgtcgacgacgttcaggccggtactggcggcggtcacgcccgtgtagcgccccgtggaggtggccgcgtaggcgccgcccgccgcctccgtgccgcccgtgaccgtcagcatcaccgagccgcccgccgggacactggccgtgtacccggtggcggacgtccccacgttctgccgggcccacaggtcacggacggtcgcggacgcgttcgtcaggccgaggtcggaccagcggacggtgatgtcgtgcgcggcggaggtgcggttgaggaggacgacggcgcggtttccggtgccggacagcaccttgccgtacgcctggaggccggtggtgtcctcggcgaccttgacgccctggaggcctcgggaatcctggtcgacggcgatgacctcggggttcttgaggatcccggcggtctcggacgtcatggtcgtcaggtcgtttccggccagcagcggcgcgccggagatcgcccacaggttcatgtgggtgcggttctgggcggcggtgaagccgtccatgccgaccatgagcatgtccgggtcgttgtagtagcccgtgtgctgcgccgtggggtgcagggtctggtcgaagttggacagcagactggtcatggacggctggttgccgtagtagatgatgtcggtgctcgtccgccacagcggggcctggcccgcggcccagttccaggggttctggtagccccagttgcagatggacagggtgagcggccggcccgtggtggcggcggccctgccgaccgcgtcgctgatggacttgtacgtcgtcgccgcgtcgagcccttccgcgtcgccgccgcaccagtcgaccttgacgaagtcgaagccccaggtggagaactggagcatgtcctggtcgtagtggccctcgctgcccgagccgggcgcggcggggcgccccgtcgggtagtagtagccgcagccgtccttgccggcgtcggtgtagatgccggccttgagtcccttgctgtggatgtaggcggtgatggcgctcatgccgccgggccactcggcggtgtcgacggtgatgttgcccgcgctgtcgcgggtgccctgccaccagccctcgtcgatgttgatgtacgtgtacccggcagccggcaggcccgccgcgacgaacgcgtcgacctgcttcttgatgacgctgtagtcgatcttcgcggcgaagctgttccaggaggcccagcccatcggcgcactgggaacggttatctgacgtgtcgtcaccgccgcctgcgcgggcgctggttggacgaagaggagggtggcggccgcggtgagcgcgaggacgagtgcgcggacggcggcgatccgcaggcggcggccgaagctccggccggtcgagcgcggtgggggaaacatgcggctccaaacccttccggaagagccgaggcgactcccggaatctgtcgatatttcgaacacagatcggctcatcgaacgattggcgcgccgaacgtagagtcccgcgagagggaagtcaacgggtgcgacacaggaggttctgcgcgcctgcgggccggggcaagcctgctgtgccgccgctcacttgactgccggacgtcccacacgattggctccggcccaacgaacagccagaccctcggcacgtatcgtcgcgacgaccgcgccgacatcacgccgccccttccttcttccttgctcagccgcacagcgaggtgccgcacacccatgaacgcttccctccgacctcacgctccccgcagctccgccccacccgcccggggcgcggccctggccgccggcgcggtcgccgtctgcctgctcgcggccggctgctccgcttccgacgggtcggacgccggcaccgaagcggcgggccgggcgggcaccgcccggatcaaggtggccctggtgacccacggcgagcgcggcgacgccttctgggacctggtgcgcaagggcgctcagacggcggccgccaaggacggcatcgagctgacctacgtcagcgacgccacgggggcgggacaggcggagctgctgcgggacgcggtccgcgaccgggtcgacggcatcgcggtgaccctggccaagccggaggcgatgaagggcgcggtcgccgacgccatggccgccggcataccgatggtcggcctcaactccggtatcgacgactggcgttcctacggcctgctcgagtacttcggccaggacgagagcctcacgggccgtgcgctcggcgacaagctggacgccctgcacgcccagcacgccctgtgtgtcatccacgagcagggcaatgtggcgctggaggcgcgctgcgccggggtgaagaagacgttcggcggccggacggagatgctgtacgtggacggcgccgacccgaaggcggtgaccgcctccgtcacggcccggctgcggcaggacccgagcatcgacgaagtcgtcacgaacggggcggagatcggcctcgaggcggtgaagtcggtgaagagcgcgggcagcaaggccaggatcgccaccttcgacctcagcaagaacgtggtcaaggccgtgcagcgcggggatgtgcagttcgcggtcgaccaacagccctatctccagggctatctcgccgtggactcgctgtggctctaccggtccaacggcaatctcagcggcggcggagaggctcccgtgctgaccggccccgccttcgtcaccaaggagaacgtcgccgaggtcgcgaagtacgcggccgacggaacccgctgagcggcgccgtcgtaccccggcgtcgccaaggttttcgctccctcacggtgcgtacggtcacttgtacggatagcatcctgcgcaccccctgtgccgtaccggccacgcggtcacccaccgcactgcgcccacggtcccctttcccgccgccccgtcacccgctgtccccctccccgctgcccctccccgctgcccccttccgctcaccgctcatcggctaggacgacgatgtctcgacgaacaggtgcccggcgccgcctcggctccatacgtctctcgctgatcctgctggcgctgctccccagcgtcaccctcgccgccatgtggggtgtgacgacgaagcagatgttctcggagggtctggagttgcggacgcagaccgagctgagcatgtcgaccggggccatggggaccgacgcgacgctcgcgctgcaacgggagcggagtctgtcggccgcctggctggcctcgcccggcggttccagagccgccctggacgagcagcggcgacggacggacgcggcggtcacccggctggtcggccggtccgacgagatcgagatggccccggcccgggtcggggaacggatgtacccggtcatggccgcggcgaagagcctggagtactaccggggccaggtggacgacccgaccgacatcaccgccaagcaggccctggaccagtacacctcgatcatcgacaaccaggtccacgccttccaggagctctcccaggtcgacgacggggatctcacctcgcaggccggcccgctcgtcgcgctggaacacgccgcggagatcgtctcccaggaggacgcccagctgacgctggcctggccgtcgggaaagctcgacgagaagtcgtgggtccgcttcgcgcaactggtcgacgcccggcgctggctcgtccaggaccagctcgtcccctcgctgcgcggcagcgcgaagacgcagacggaccggatcctgcagagtccgcaatggcagaccctggaggacgtcgaggaccaggtcatcgcggcccggacggcgaacggcagcgtcgcgcggaccatcgagctgccggacgcgcgaaagcgctggagcgccgcgctggaccaagtctccgcgcagtacgcgaacctgatccaacagcagacctcggccctgctcgaccgcagcagtgacaaggcccgcggactgctgatcaaggcggcctcgctgagcgccggcggactcgccgccctgctgctgtgcgtcgtactgtcctggcgcatcacccgctccctgtcccggcggctgcgggggctgcggatggccacgctcagcctggccgaggagcggctgcccgatgtggtcgcccggctcgaccggggcgagaaggtcgacgtggactccgccacaccgccgctggactacggcagggacgaactcggccaggtggcccaggcgttcaacaccgcgcagcgcacggcggtccacaccgcggtggaactcgccgacacccgacgcggcttccagaaggtcatcctgggcatcgcccggcagagccagaacctggtcaacctccagctcagcaagctcgacgaactggaacgccggcaccaggacccgcacatcctggagggcctgtacgaactcgactccaccgcgagtcagctccgccgctacgaggagaacctcgtcatcatcagcggcgaacagccccggcgcagctggaccgagccggtcgccctgatcgacatcctgcgcagcgccgtcggcgaggtcgccgagtaccagcgggtggaggtgcacaccgacgaagaggtgttcctgaccccgcccgcggtggccgacgtcatccatctgctggccgaactcatcgacaacgccaccgcgtactcccccgcgcccagcccggtgggcgtgcgggccgcgatggtggccaaggggctggccgtcgaggtcgaggaccgcggtctcggcatgtccgaggaggactacgcggccctcaacgcccagctcgcggtggtcccgcagttcgacgtggtggccctggccgacgacctccggctcggcatgttcgtgatcgcccggctcgccacccggcacggcatcgccgtcaccctgcgttcctcgccgtacggagggaccaccgcgatcgtgctgatcccgcacgccatcgtggtgcgcgaggcctccggctccccgtccacgaagtccacggacaccgaaccggccggctccgccgacgcacggaccgtcgaaccggccgcagcggcgaagggcaccgccggcaccccggatccggcccgccaaccccacgaacgcacgcgggaggcgcggccggccgcgcgggcccggacggccgaagtccccgcgaacggagcggagtcggacaccgaaggggtacgcaggacggcgggccgcacgccccgccccgaacccggtggcgtacgccgcgagggactcgctccgctgccgcggcgggtgccgcagaccagcctggccgccgagctgaaggaggaggccgcgcccggccgggaggacgacgacccctgcgaggacttcaccgcggagcgtgccgccgcctcgctcgccggtttccagcgcggaacgctccaggcccgggacaccaccgccgagggggcgtacgaccaccgggaggaagccgccgccgaagacccggacgcccgggttcccgccccgggcgcatcgtcccccacgctctcgactccgcccgcagaccgctcatgaaggacagggaaatgacacgccccacccccgccacgcacagccagctcgaccagttgctcaccggactggtcgaccgggtcgccgaggtggaccacgccgtcgtgctctccgaggacggactggtcgtcagcaagtccaccgggttcctgcgcgacgacgccgagcggctcgcggcgaccgcctccgggctgatgagcctcagcaagggcgtcagcatggacttccgccgtggcccggtgcgtcaggcgctcatcgagatgggcaagggctatctgatcctcaccgccgccggccccggcgcccatctcgtcgtcctcaccagacagggcgcggacgtgggtgtggtggcgtaccagatgaacatgctggtgaagaagatcggcgagcacctcagcgcgccaccgcgtgggggcgcgggcaccgcggccgacagcggcgagtgaggtgacggatggcgacgcggctggtcgtctggtgcggccgttcacgctgaccggtggccggacccggcccagccgggccgacttcaccctcatcacgtcggtgaccgcggtggaacggccgcccgccgggagcttccgtccgcagcccgagcacacccggatcctgcggctgtgcgcggagccggtcgtggtggcggaactcgccgccgggctcgaccttccggcgagcgtggtcgtcatcctgctctgcgacctgctggaggcgggccggatcaccgcccacccgccgcgcctcctctcccgcaccacggacctggacctgctgcagaaagtgagggacggccttggccggctctgaccccgccgcacctgccgcccccgcggccgcggcacccgacacggtcaagatcctgatcgccggcggattcggcgtcggcaagacgaccatggtcggttccgtcagcgagatcgcgccgctgcggaccgaggaaccgctgaccgccgccggcctggacgtcgacgacctcgacggcatcgcggagaaggacgccaccaccgtggccctcgacttcggccggatcacgatcggctcggaactcgtgctgtatctcttcggcacccccggacagcagcggttctggttcatgtggaacgacctggccatcggggccctgggcgcggtggtcctcatcgatgtgcgcaggccggagtccagcttcgccgccgtcgacttcttcgagcggcggggcatcccgttcgtcatcggcgtcaacggtttccacggactgcatccgtacacgcccgaggagatccgggaggccctggccctgccggagcgggcccaggtgctgctgtgcgacgcacgggagcgcgagtcgtgccgggacgtactgatcgccctgatcgaccagttgatcgccgcccgctgacgtggccgagccggcccgtcgcggggccctggcggccgggcgggggtccgccccgggctatgcggccgcccgcgccccggccaccggaagtcccgccgtacgcaggacccgacgctcggcgtccacggcgaacacctcgcagccgtccagcccggcggcccactcgacgccctccgtgcccatcgcgaaggccgccgtcgcgaccgagtccgcctcggtcagtgtcggcgccacgaccgtcaggctgagcaggccggtcgccggtcgcccggtgcgcccgtcgcggatgtggtcgccgcgttcgtagcgcgcggaggtcgcgaccgccccgtcggtgagctccaggaccgtgcacagcttgtcggcgtgttcgggatgccgtacgcccacccgccagggaccgccggcggcggccacgtcaccgccggcgttcaggcagaacctccgcgcccccgccgccgacagcagctccgccgcccgctgcaccgaccagcccttgaccaccgcgcaggggtccaggccacggccgggcagccgcacgtcgaaggctccgccggtggcggcccggtagtgctcgcacaggtcgaggacctccagcagatccgcgctgagcgcgtcctcgcgcagctcgccccggtccagccgggacacctcgctgtcggccttgaaggggctgaaccgcgcgtcggcctcccgcagccaggcgaacaccgcgtccgcggccgcgtcgaagtcgccctcgtcgtcgatccgcagcgagaccgggaaccccatgacgtgttcgacgcgccgcacctcaggcgcccttcgcgtcgagggcggcctggagcgactccttgtacccgtcgctggtgacggtcgcgccggacaccgtgtcgatgtccgcgctctgcgccttcagcgtctccgcgaccagcttcggcaccgccgccgtcgtctgcggatggttcggctgccgcaacatccgcacggcgctgatcgtgtcgccctcgaaggtcacctcgacctgcacggggcccttctcggtcttgacggtcgaccccgcgacgacctgggccgaagaacccggcgaagaacccggcgaggaggacgcggaaggcgacgcggcgggcggggcggtctgggtggtggacgtcgtgtcggtcgacggttcgtagcgccacagcgggatcaggcccgcgacgctcaggaccaggacaggaagtgctcgtttcaccgggatttcctcgtctccctcatccggccaggctgaagcgctcgtggtggatctgctgcttgggcacgcccagctcgcgcagggtgcgcagcagggtggtggtcatcccgggcggtccgcacaggaagacgtcccgctcggcgatgtccggtaccaggcgggcgagttcgctcggggccagcctgtcgggggcggccggcccggtcaccaggtggagttcggcgcccttggcgtgggcgagttcccgcagctcgtcgtagaggacggcgtcgcggtcctcggccacccggtagatgaccaccgcgtggccttccaggtcctccagcagcgcccggatgggtgtgacgcccaccccgccggcgacgagcagggactccggacgcgtgcggtgcatcgcggtgaaggcgccgtacggcccctcggcgaagacccgcgtgcccaccttcacatgccgcagggccgcggtgccgtcgccggccgtcttcgcggtgagccgcagccgcgtgccgtcgggggcggccgacagcgagaaggggttggcctgccaccagcggtcccgggtcaggaaccgccacaggaagaactggcccgcccgcgcgggcatccggtccaggtcgcggccggagatgtggatcgagacgacgttgtcggactccgggaccacggccgtgacccgcagttggtgacgccagttccgccacaacgggagcaccagccggcccacgagcaccgagccgagcgcgacgccccacacggcgtaccagtacgccgtggcggcggacgacgaggtgaaggtcgtaccggccgcgacctggtgcgtgaacgcgagcaccacggcgacgtaggtgtacaggtggatgaagtgccatgtctcgtaggccagtcggcgccgggcgtaccggccggagacggcacccacgacgacgatgatcgtcagggcgacgaccgcgcggagcacgccctcgacggtctcggcgaggtccaccagctggttcaccggatccatcgacgacgactgtgcgtaaccgaaggtgatgaagacggcgtgcgcgagcagcgtccacaggatgccgaagccggtccagcggtgccagctggtcagccggtccatgccgatccggcggtcgagccacggcagccgggccaccagcagcagctgaaaggccatcaggagggcgccgtacaggccggccagccggcccagcacgatcagcgcgttcgaggcgaacccggcctgggcgaagaggaaggccaccacggccgcgttcgcggccagcacggcgtacaggcccgcgcgggccaccaccctggggcgtatcgccgtggggggcgcagggggcgattggacggtcgtcacggacggcagctccttgatcgggtcctgggacaccgagcttcgctggcgagagctgtcgttttcctgtcgccggactttcaactgcttatcgatatgggtccggggggtggcccgctctggcgccctgggacacgtgaagcactatgagcaggtggaaaaagtacgactcctcgtcgtggacgacgacccgcccatcgccgacctcgtggcgacggtcgcccgttacgagggctgggacgcggtcaccgcgtactcgggcgaggaggcgctgcgcctggccgcggagttccctccggacatcgtggtgctcgatctgatgctgcccgacatcgacgggttcggcgtcctcgaccggctgcgtcggtccgggacgatggtgcccgtcgtgttcctcaccgcccgggacacggtggccgaccgggtcgcgggcctgaccaggggcggcgacgactatctggtcaagccgttcgcggtggaggagttgatggcccggctgcggaccgtgctgcgccgcagcgccggacccggtttccagcggtccgtgctccgggtggccgacctgacgatggacgaggacacccgtcaggtgcggcggggcgaccggctgctgacgctcacgccgaccgagtacgaggtgctgcgctatctgatgcgcaagtcgccggccgtgctgaccaaggcgcagatcctggaccacgtctgggagtacggcttcgggggccgctcgaacgtcgtggagctggtcgtcagccgcctgcgccgcaaactcgacgaagccgacgctgccgatgccggcgacgtcgccgccgaagacagcgcggccgacgcgggcagggagccgctgatccacacggtccggggcttcggatacgtgatccggccggcggcccggtgaccgggcggctgcggcggacgtaccgcaggctgcgcctgggcacccggctggcgctgggccttggcgtgctgtccctcgtcgtgttcgccgtcgtcggcacggcgctgaccacgtacatgcgcgactatctggaagcccagctgggcgaccagatgaagctcgtccaggtcctgcagtcgaaggacgcccaagtgcacggcgtcgtgcagcgccagccgtactacggctggtacaccgcggtgtacgacgtctcgggcgactcggccgtgctgcgcaggccggccgacgtaccggccgacacccgggcgctcaccgctctcgccgagacgatggcgcactcggacacggaccttcggcgcaccgtgcggatcgacggcaagggcacctaccggctacaggcgtgcgaggtggaacccggtgtggtcctcgtcagtgccgcgcccatggcggacgtccaggcgaccgtgcggcagctgatcacggtccaggtggtcgcgttcgtcctcgcgctgctggccctggtggtgttcggccgggcgatgctgcggcgcggtctgaaaccgctgagcgacatggcgcacaccgcccacggcatcgcctcgcacaatctgaccgggtcggcggcgcggctgccgctgcgcgacgacggccgcagcggcggtccggaggtcgaggagctgcgcaccgcgttcaacaccatgctggagcacatcgacggttcgctcgccgtccgcgcggaggccgaacagcggctgcgccgcttcgtcgcggacgcctcgcacgagctgcgtacgcccctgatgtcggtacggggttacgcggacctgttccagtacgcggccgccaacgcgcccggggaacgggacaggcatctggcgcggctgcgtgccgaggccgccaggatggggctgctcctggacgacctgctgctgctcgcccgcctggacgccgcggaggtggagacaccgctgcggatggaggacgccgacctggtggagctggtgcgccaggcggcggacgccttccgcgcgggccacccggaccgtccgctgacggtgacgaccggtcccgacgccgtaccgctgcggctcgaccccctgcgcatccggcaggtgctggacaacctgctcaccaacgccgccgtgcacacccccgccggaacggaggtgtccgtggaggtctcggtctcgtccggcacggcgtgggtgggggtcgccgactcgggcccgggcgttccggcggccgaccgggagcgggtcttcgaccgcttctaccgggtggacaaggcccgcagccgcgaccgcgggggcagcggcctgggcctggcggtcgcccgctccctggtgcgggcgcacggcggcaccgtcgcactgaccggcgaaccgggggcgacggtcttcaccctcgggatcccgctgggccgcagggactagcggggttcggcacgcaggggtgggggacctcaagagccggcgatgaccggcatgcccgcaccacccgcacagccgcgccggtccagccgctcgagccacaccaccagggcgagagagctgttcatccggtcccaggagtacgcgtcgcccaccccgagctgagcctccctcacagcccggcacagcgtctccacgtcgaacatctccgcgaccagcggatgcctcgcggagcggcagaggtcgatgagttcgtcgccgtgtctgcgcaggccgcgggcgtagagctcgtcgaaggggaccttgaccgctcggccgcggatccgggacggaagcagatccgccatggcctcgcgcagaaccgccttcggacggcccggacggaacgtggcttccggagggaggctgcgcatcgtggcgatgacctcgtggtcgagaaaggggtgcgagaggaagaatccgtcctgccgtgcgcggcgccaggagagcgggtcgggagcggcgaggtaattggccgcctcgaagagcgactgttccggcctgcgcccgaacacgaagcggctctccgcgatgccggcctcacggtagccgtgagcccgcgcgaatccgggtcgcagccatcgggggcgggtgaagctgccgaggccgcccagcaccgttccgcggcggacgagcgcggtgatccgttcggcggtcagcggaagagccggccgcatgacgtagtcgcagacgacgtcccgcacgccacgctcgctgcccgcggcccaggcacgtgcctgcttcgtcagctgccggagctgccctgtgcgggccagcctgtgcaggtgaaaggggttggcgtccaccatcgcatcggccccgcagccggtcaggaggatgtcacagcccagctccgccgcagcggcatggagcctgctccagaacggggcgcgaaaggcgtgcgcatgaggctcgtccgcgtctcccgcgtggtcctggaagtcgtcgaagtcagccacgtcgccgacatcgaccatcaccgggcgggccccgggtgcgtgccggtggatctccttcatcgcctcgtcgaggtacggctgctcccccgccagctctcctgtgccgaagcgcccggcgagcaggacaaggtccctggggctgtcctgtcccgcggccgtcggacgggctgcgagcaacgcgacgctggtggagtcggtgccgccggagacgtgacacgccgtcatggtgcccatgcggcgcccgacggcgtgctccagtgcgaggcgcagctccttcgcggccccgctgagccggagcccgtccgctgtcgagtcccacgggtggtcggcgtgaccgacgcgtcccagcgcccgaccgcgcatccgcccggtgatcgagagctccacgacctcgccgccgaggacccggtgcacgccggcgaaaggggtgagttccgagtgcggttgcgccatgttcccggtcaggtaccggcagaagtagcgacgttccagctcttcgaagtcgcccagccggcgcgccgaggtgctcaccgcgctcacctgtccgccggactccctgaagaacagggggatgcgtgcttgctcgtcccgcatcagcaggacgcggtcgcggcacaccaggacagccgcatagtcgccggccggcagacgcggtgcggctcccggtcggccgaagtcgtccaggaggccgtgcgcgcccgccacgcggtcacggaccgagccggcccagccgacgaccaccgcggtgccggcccgggaggagaccgtcgtcacgagtccctgccgcgccatggcctcggtcgcccggagcctcggtgcgcccgcggcccactcgaggcggagcgcttccacgtcactgccccgcgcaactgatcgagagcaccggcgcgaacgcgtgccctcgcggatcggcgtcagggatgcacaggcccgccgaagacgtccaggcgtgcagggcgaacgggtgctcgcgcacaccgacgtggagcacggccttcaggccgcaccgccgcagcaggacgaaagccgtcacggcctcggtcttgcagtcgtcgttgacgaaccaactgctgcggctgtgtgaccgcaccgctcgtttcaaccgctcgacgtcctccgcggacggggggtcggcacgggcgtagaccggggccgccaaggacaggagccgaaggacgcgcccgaatcccagggtccggatcagcaggtgcactccgcgcaaccagagcccgacctcgacgtccgagtgccccttccggcgggccgtcgcacacccggcacggatgagcccggtgacgagttcggcgcgttcctcagagcttccgtcggcgaacttccgcatgtccgtcgcagtcatgccgagaaaacgcgtccgccgcctccagtccgcgatcagagctccgccggacatcctggtgacccggcagtgcggtgacaggatccgcgtcatggccgccagggcatcggtctcctctgccaccccacatcctccaaggtgggcccgccgcggtgactccgcggcaggcccggttcgactcggtgggcggtgttcaggactgatatccgtgcccgtcgtagaggccgccactgaagccccggatcgaacggccactgccgagaaggacgagcccacgcggcatacgacgccgcagtcgtcgaagaaacatcgcctacctccagaatcaggcggtgtcgatcaaatccaggctactctgccgcgaatgccccgcaaccggaccgcaacccgaccgcgaccgcaccgcggtccggtcgcggggtgaccgaggtgctgccgcttcccgcttgtggtacgggtgttgaaacccaggcggtacgggtgtggaaacccaacgacacgccctcgccccctcggcacccctcagggctccggtatgtcgtccgggcggagggtgagcagttcctgatgggtggggcggtcgatgtcggacaggcggcccgccatgtgttcgatcatggtctcgaagagcgtgcgggcgtcccgcccgttggacgggctgccggtgctcgcccggccccggaagcgggccaggagccggggctccacgtccgggtcgagctcgaagccgtgccggtccgccaagtggcgcacgatgcggaccagttcgcccgggctgtacggcgagaacgtcacgatccgggagaaccgggacgcaaggcccgggttggcctccaggaagccctccatctccacggggtagccggcggcgatcaccacgacgtcctcgcgatggtcctccatcagcttggtgagctcgtcgatcgcctcctggccgaggtcgtggttgacgccgaagcgccgggccaggctgtacgcctcgtcgatgaagagcaccccgccgcgggcgctgtcgaagaccgcgcgggtcttcagggcggtggagcccaggtactggccgacgagatcgctgcggtgcacctccacgagccggccgtccgacagcacgcccagctcggcgaggatccggccgtagagccgggccaccgtggtcttgccggtgcccggcggcccggagaagaccagatgacggccgccgggcggttcggacaggccggcgtcgcggcgcagccgggccagccgcagcaggtcgacctgggtacggacctggcgtttcgcctcggtcagaccgatcagcgcgtccagttcggcctgcggtccgagcccggcggcgggctgcccggccgggggcggcgcgtcgcgggtggtgacggcgtcgaggcgtacgctgccgtcgcccgcgacggcctcgccgcggctgccggtgatccggctgtccgtgatccggccgctgacgtcgctccgggtgcgcagcccgtcgccgtcgctgccggtgcaggagctgtcccggatgtcgaactggctgctgttctccgcgaggatcccgtgcgcaccggagtccgtcacggtcagttggtccgcgaccaggacggcgctgtccagaatgtgcgccccgtaccgcgcggcccgctcgaccgtgcactgacgcaccgtcagatatgaggtgtcgcgcgcgaagaggccgtcggacacgggctcggagatccgcaggttccgcgcgacgacccgggcggatccggtcagtacgagagcgcagtcccgcattccgcacagctcggcgccggtgagttcgccggatgatccggagccggacgcgtgcaggccgtacttgcagtcgtcggcgcgcagttccgcggcctcgaaggtgccgtcctggcacagccgcaccacggaaccggtgagcgcgcgggcctcgacccgctccaggctcgcgtggcccttctccacgacgacaccgtgtctggcgtcgacgatgcggcaaccgttcacccggagccgggccttctggtcgacgctcagggcggcgttggacaggtgctcgaacgagcagtcctcgatcccgcacacggcttcctcggtcacccgcaccccgacggcccggcagccgtggaaggagcagtcgcgcagggtcggatccgcgccgccggagacgacggccccggcgtccgcgccgcgcacgcgggtcccgacgacggtgccgtgcccctggtcgcggaagccgagcgccgtaccggacaggtcgcgcagcagacagtcgcgcacctcggcctcggcctgctgctcgaccagcacgccgtgtccgccgaagccggagaactcgcacgtccggagccgggcccgggtgcccgccccgctgacgtggacggcgctgccgcggccgtcggcgaagacacagtcggtgacctcggcgtgcgcgccctgagacacgaccagcgcgtcctcgcccgccgcctggaaccgggtgccgcgcagcacggcgcgggccccctgcaacgtcgccttgccgacggccagttcaccgcccatcacggtgatctcgctgccggccgaggcggtcagggcggccgctccgtcgcggccttcgagccggcagtcgcgcagcagcagccggccgaagaccgcgaccgtcgcggtgccgcggcccacgaccgccaggcccgtgaccaccgcactgccggtcacgtcgagcacgttcgccccggcgacggccggttcgacgaccacggtccccgggccccgcgcggcacagagttcgacctcacccttgagggacagcggctcggggtagcggcccggctcgaccatcacccgcagcggccccgggccggtgtgtgcgcgcagcgcggcggcgatggtgcggtggccgctgtcgccggtgggcgagacacgcagcacacgcagctcgccgggggccgcggagcgggtcccggacggcggggcggacggcgggtcggcgggcggtacggcggcgtcgagagcgggcgcggaccagcgctgggcgccgtcgccgtcccgggccggcccggcgacccgcaccccgaacgtgtgcagcgcgtgggcgagttgcccggggtggacggccagtccgagggcctcgcccggcacaccggcgagtaccgggacgatccgcagcgtgccgtcgggggcggcccggaagcagtcccgcggcggtgcggcgcccggctcggggacgagcgggcgcgcgagcagggcccagcggtgctgccgcccgcgtgcgccctccggggcggagccgatctccagcgactccaccgcgctccagggcagggcacggtccgtgccgccggcgtgcagccgcagccctcccgcgtccaggtgcagcgcgcagcgccgggcgaggaggtggtcgagcgcgaggagcgcgggcagcaccacggcaggggcggcgagtccggcgccgaggtaggcccagtgcaggcccgggcccggccgggtagcggcgaaccggaggtagccgtagcaacaggcgagccagacggcgaccgacagccgtccgccgtagcccgccgccctgcgggtcagcggtgaacgcaggcggcccgggatgcggtactcactgccggtggccaccgcggaggtggttgccgggggcagtccggtacggcgccagcgggggcccgcgtgggtgtcgagcgcgaggtccagctcgcggggctcgacggccagcgggcgcaggtcgacgctcacacagcgccagcccgcgtcccagcggggcgtcaactccactgtccgcagcaggagtccggccggcccggtgatccggcgacgcgggcccggagcggtcgcgggcgcggtcaggggtgagggcgtgggcggggtcgtaggtgcggtggcaggtgcggtggcaggtggggtcgtacgtaggagcagctgctccgggaaacggtggccggtgcgcaggatgcgccggtccacggccgggaccacgcacagccagtcgagttccggccaggaccaccgcagccggcgcagcggcccgtgccactcgatgccgtcgatgtccaccgtgagcgcgaccggccacagagaggtcagcaggagccgcacacagacgacggcgaggacggctccgcccaggacgcactcggccaccaccggcacgggggcccgcacggcgtgtacggcatccgcggacacccagcacaccacggcgccgacgcccgcacccgaggccgcccacaaccgtttgcggaccgtccgccggtcccggtgaaaggtggtgcgggccgcggcgggacgccgcaccggccggcggggcgcgggcaggggtgtgccgtcggtgggcgcggcgtcgtcgccgctcccggtgtcatgccggacgtccacccgtaccccccgtgtcgatgtcccggctgtcgagtgcctcgtccccacgggtgcacttcgaccaacccaggaccagcgtaaaggatgggactaccatgagtgatgtgtcgtcacacgaggatcacgaccgtcaactggcgcttctctgccagcagttggcgcggctgcgcaggatgcaccgggggccggtcggcgcgtcggggcggctggtgatcgaccgtgcggtccgggccgcccgcgagggcgggccgatcggcgaacacctcgaagccctgggcctgctgcccgggcgcacggcggacgaggcggacgagggtgcgccgcggggcaccaccctcccgccccgggtgacggacggcgccccgcacgccctgctcggccagcacgtctgcccgcgcggggtctgtacgcggcgggagcagcgggcggtcggcgaggagcgtccggtgtgcgagatcttcgacctggcgctgcgcttcgaccccgagaggtgaacgggcctacatgctctccggattcgtcaccgatgtcggccggaaactggcggaacgctgggccgccacgctcgtcctgcccggcctgttgttcacgaccgtcgcggccgtcgccctgaccctgcgccagagcgcctggtcggacgtggacctgctgcgcctgcgggtgacggcgctcaccggagccggttcgggggcgggccccggcgcgggctcgggttcgacgcgtacggcggtgctgctgctcggtgtgctggccgcgtccttcgccgccgcgctggtggccgacgcgctcggcgggccgtacgaacaggcgttgctcggcagctggccccgcctcctgagccggcccgccgccgcgctcaccgggcggcggcgcagaatctggcaggaacgggacgacgcctgccgccgggccgtggcgcaggacacggagggggccgccgaacgtgccgcccggctgggcgcgttggaggtgctgagaaaccaagtggccctgacccggccggaatgcccgacctggatcggggaccggctgcgcgcccccgccgtgcgcatccggctggagtaccgcctggagctgtccgacgcgtggccccggctgtggctggtgctccccgactccacgcgtcagccgctggccgaggccaggcagcggctggacgaggcgatgcgcctcggcggctgggcggtcctgtatctcctgctgggcgcggtgtggtggccgagcgccgtggccggggcgggggcggcgctggtggcctggcggcggggccgggaccgggccgaggagtacgccgagctcgtcgagtcggcggtcgatgtccatctccaggagctgttcgaacggttcgacgaggaggcccgcccggtccgggcgagcctgggccccgccgtcaccgaacggttccgcaagggcgcggggccacgacgcccgtgacacgcgggaccacgacgcccgtgacagccgaacgcgggagcggaggacccctgccgcccggacacgggagcgacgcacaggacacccgggcaccggaccacggcgcccacaccacgggaccggacgcgagaacggggtgcacgagatgaccgagccacagcagttgcccggggaggaccggccggcggagcgggaacggctgctacgggcggtacgggggcgcctggacgcgctgggcggaccgacgggcaacggccatctgcacaccgcggaggcacgccaggagaccgaccgtctgctgcgccacctcgtggctccccacccggccacgggcggcggccacgcactcgacgccgaagtggcgtacgtactcggagtgatgtatctgttcgtcgcggacgaccggcccgacgcccccaccgccgcacaggacggccagtgcgccctcctgctgctcgcccccttctactgccacctgccggaccagccggatgtcctgccccctcccctgcgcgccggactcgaccagctcctcggcgccgagggccgacggcccgacgcccccgaggagatcgtccaggagcacgccgcgtccctcgccaacctggcgatgctgctgctggaactgggcatcaccctggcgtacccggaagccatccgcgttgcggccgacctggcccgcgaggcccttccccatctgtcgcccgacggccacgaccgcgccctggccggatgcaacctcggctatgccctgctcctgagcggcccgacccccgtctcctcccccggccaggccgaccccgagcagctggcggaggccgtctccgtgctgcgcaccgcgttcgccgccaccccgcgcgagcacccgaaccacgcccggtgcgccaacggcctcggcctcgcgctgctcgcctcggccggtcaggccgaggaccgcacccaactggccgaggccgccgcgatgttgcgcatcgccacccagaccgccacggaggtcgaccagaacctcccgcagatgtactccgacctcggttacaccctcaccctctgcgcccgcaccgccggggagggcgaggagccgggcccggaggtccgcgaggaggccgtcgacgcgctccggcgtgccgtggacctcaccacgcccgccgaggacggggagatgctgcgcacccgcctcgaccggctcgccgacgccgtggtgatcggctccccctcggacgaccggccgcgcgccgccgcacaggccgagcaggccgtcgacaccctgcggcgcctgctcgacctcacccccgaagggcacccggagcggggggacgtactgctgcggctggcggggaaccggttggtggcacagcatccgcaggagaccatcgacctgctggtacagggcgagtccgcgtacgccacagacccccgccgggagcagatcgcccgggcgttgctcgtggaggcggccatgctcaagggagagctggactcccgcgcggacctcacccccgagcagcaggcggactggcaggccatcgacgacgtcatgctcccgctgctgtccggggacacgaccggccacccgatgcggtccgtgatgaatctgatcggcctcggcggggaggggggcgggagccgcagccaggaactgatggacttcggcagcatggtcctcggctacccggaccgggtcggcctgaacgagatcttcgccaaggcgatggagctccaggcccggcgcatcgccaggctgcccgaggaggaacgcgcgggcgccgtcgccgcgttcctggcgggagacgacgacgagggcgcgcccgggccgccgggcgggcgggtcgaggagtccgaggagccgccggacaccagcagcctcgacgagctgctggagatccacgaacgactgctgccgcggctgccacccgactcccgcgagcaccgcctgctgcacggcgggcggaacatgctgcgcctcgtgcagatcatgtacgagtccatgtacgcgccgggcgacacccggacgcgtctgcagctgatgcgccgggccctgccgctgatgcgggagctgttcgaggaactgcccgcccagttggaggagctggggatcaagccggagctcttcggcgcccatacggcactggcgttcgcgtacgagtcgccgttcgagcagctggaggcggtcgaggagggggtgcgggccgcccgccggaggctcacggaactcgccccggacacgccggagtacgccgagacccggaccaccctggccctgtccctcttcgtccgccatgccctgtggtccgaggaggccgactacgaggaggccgtgggcatcgcccgggagctgacctcggcgccggctcccggctggcgcacggccatgctgctgacgcagtggacctccgcggcccagtcgcggatccagcgcaccgggctgctgggccaggcaccgcccggggtcgggcagtcgcccagcctgatcacccggctggcctccgacggcgccgccaccgcgctcgacgaccgggaccccgtggaagcgctggagaccctggaggacggccgggcgcatctgctgtcgggggcgctcaacgcccgccgcgaactggaggtcctgcacggtgcggacgccaagctgcacggccggctgcgggccgcgctggaacggatccgggcgctccgcacggcgagggaaccgggccgatggcccacaccggacgaggaggacgagctgcggtccgcttccgacgacgcggcctggctcgtcgccgaactccagcagcacccgggcttccagcgctttctgaccccgcttcccctgggtctcgacgacctgctgcccgccgccgcggaggggccggtggtgagcgtcaacatcaacccgcgccgctgtgacgccctggcgctgtgccccgacgggctgcgcgcggtaccgctgccgcggctgtacgcctccgatctggtggcacaggccgagtccttccgggtcgccgtcgaggcactgacggccggaccgcgcgaccctctgttcgaggacgcccgggagatcttcacgggaacgctggcctggctgtgggacgtactggccgaaccggtcctggacgccctcgggttcaccggtccgccggagtcaggagcgccctggccccggctgtggtggtcgccgtccggggtgctcaactcctttccgctgcatgccgccgggcgccacggcagcggggaggcggcggacgccgccgtcctggaccgggtggcctcctcgtacacaccgaccctgcgcgccctgctcttcagccgggcccgcaggcgcgcggcacccggccggcggcgcaccctggccgtggccatgccgcagaccgccggacaggccccgctggcccgtacggtcacggaggccaccgaggcggtggcggcgggcggaggcgttccgctgatcggaccggccgccacccgggactcggtgcgtgcggccatggtggacgcggccgtggtgcacttcgcgtgccacgcggacagtgaccccgaggacctgtcggccggccggctgctgctggccgacggcgacctgctgatccgcgacatcgccgagctccacctggagacggccgagttggcctacctctcggcctgcggcacggcccgcggcggcgccaccgcggcgctcgccgacgaggtgatccacctgggctccgcgttccagctcgccggctacgcccagtcggtggccacgctctgggaggtgggcgactccttcgcggccagggccgcggccgagttccaccgcaccctggccccctccctcccgggccccggccccctgcccgcggccctggccctgcaccacacggtgcgctcgctgagacaagacgaccgggagcggccttggacgtggtcggcgttggtgcacgcgggggcctgagcggcgcgtgtgcggcgggcggaagacgggccggagacgggcaccgggcgggcgccagacgagcggacgagcggacgagcggacgagcgccagacgggtaaaaaatcccgatttaggagggttcatttcctgttgaccgcactagaatgagaaacagcctgcgggacgagcgagggagttcgaccggagtagccgactttggcgtgaagctgggagtacgtggtttccgcccgggccgacgtcgacggtcgggctgagaggctggaaggtcgcaggacctgacagcgacctctggaacctgatccggaccataccggcgcagggagcccgtctcgcaggttattcgtgtgcgaagcgacgcacccacggaccccgcggtattgtcctgacatggatgccgtacgtgcggtcctgatcgacatcgacggtgtgctcaccgtctcgtggaagccactgcccggcgcgatcgaggcgctgcaccggatccgcgacgccagcctcggcgtggtcctgctcaccaatacgacgtcccgtacgcgcgcgtcgatcgctgcgacactgggcgcctcgggcttcccggtgagcgccgaggacatcctcaccgcacccaccgccaccgcggcccatctcaccgaccactgtcccggcgcccgctgctccctgctgaacagcggtgacatccgggaggacctcgtcggcgtgaccctgctcgacgacaccgacaccgtcccggacgtcgtcatcgtgggcggtgccggcccagagttcgactacgcggcgctcaaccgggtcttcggccacctccagcggggcgcccggctggtggcgatgcaccgcaacctgtactggcgcaccgaccgcggactggatctcgacagcggtgcgttcctgctcgggctggagcacgccgccggcactcgggccgagatcaccggcaagccggcgcccgcgttcttcgaggcggcgctgacacgcctcggggccggccccggccaggcggtcatggtcggcgacgacatcgagtccgacgtgctcgcggcacagcgcacgggtatcaccggtgtcctcgtcaagaccggaaaatacctgcccgaaacgcaccacgcggcgagcgcacggcccgaccacgtcctggactccgtcgcggatctccccgccctgctggactccgtcgtgcgccgctagggcctgcccgaggggtcacccccgggcgtgcccgcctgcctcagccctcgtccggcgccagccgcaacgagatggagttgatgcagtaccgctgatcggtcggggtcgcatacccctccccctcgaacacatgtccgagatgcgacccgcagcgagcgcaccgcacctccgtccgcaccatcccgtgcgaacggtcgtcgatcagctccacggcgtccgtgttcttcgggtcgtagaaggacggccagccgcagtgcgactcgaacttctcgttcgacgtgaagagctccgcgccgcaggcacggcaggagtagacgcccttcgtcctggtgtccgtgtactcacccgtgaacgccggctccgtgccggccttgcgcaggaccgcgtattcggccggggtcagctccgcgcgccatgcctcgtccggcttttcgatgtcgtacgacacgagcctcagcccctcactgcttcgacagacggtccaggatccgcgggccgagctccgtcacgtcgcccgcgcccatggtgagaaccagatcgcccggcctcgccattcccgcgatcaccgacgggacctccgccttgtcgtgcaccggcgtcacgtccgcgcccgccgcccgcgccgcctcgatgatcagctcgctcgtgatgcccgggatcgggtcctcgcgggccgggtagatgtccaggaccacggacgcgtccgcgagcgccagggcctgccccatctccttgcccagctcctgcgtgcgcgagaacaggtgcggctggaagacgaccaggatccgtgcgtcacccgccgccgcccgcatcgcctccaggtccgcggtcatctccgtcgggtggtgcgcgtacgagtcgatgacctggacgcccgcctcctcacccttgagctggaggcgccgcttcacccccgtgtaggcggccagggccgaagcgaggtccgcggccgggatgcccagcgccacccccgccgcgagcgccgccaccgcgttgtgcgcgtagtgccggccggggaccgacaccgtgaaggtcagctccgtgccgtcgagcaggacctccacctcgctcttcaggccctgcgcggtcacggacaggacgcacacgtcggcgtccgccgactcgccgtacgtcaccacccgtacgccgctcgccgtgacgcgccgcgtcagctcccgcgcgccctcgtggtccgccgcgatcaccagcgtgccgccctcggtgatgcggtccacgaaggtctcgaaggacgcgtagatctcgtccatggacgcgtagttggcgtggtggtccagctccacgttcagcacgatcgccacgtcgggcgcgtacttgtggaagctgcggtccgattcgtccgcctcggcgacgaagatgtcgccctcgccgtgcagcgcgttcgagccgggggcgtccaggtcgccgccgatcgcgtacgacggggcgaggcccagcgtggacagcgacaccgccagcatcgacgtcgtggtcgtcttgccgtgcgtgcccgccaccgcgatcgggcgcaggccgtccatcagccgggccagggcgtccgaacggtggacgaccgggatgcccagctccgccgcgcgggccagctccgggttgtccgcgcggatcgcggaggagacgacgacgcacgtggcgtcgtcggcgaggtgctcggccgcgtgcccgatgtgcaccgtcgcgcccagtgcccgcagggcctcggcggtctcggactccttcgcgtcgctgccggccaccttggccccgcgctgcgcgaggatcttcgcgatgcccgacatcccggcgccgccgatcccgatgaagtgcggtcggtccatggcggtaggaagaccgggtgccatgcgtgtttctccccaagaggtgcgacgagcggtacgtggtgcgactagcggtacgacgatgcgcgcactccggagagcgagcgcgccccaagcctatgccttgccgtacgggccccgtgcaggcgacgccccacggggccggcgggcctacgccctgccgtgggggacccgcgggcctacgccttgctgtgcgagaagagcttcagcaccggcacccccaccttgtggcgcgctctcgacgcccagtcgcggtggaagaactcctccacgtagtgggggtccgtcagcacgatcacctcgtccgcgtccacctcgtccaccagcgccttcagcgcgtccagcggatggtcctcgatgaggcggcccaccgcctcgctgccggatgcgtgcagggcggcgagggacacctccagagcctgccccccgagggccgccgcgtccttgccctccggggtctcccgctcgtgcgccgcctcgtccagctcacccagcgcgacgtcgtcgatggcccgcagcagccggtccgcctgatcaccgcggggttgcagcagtacgtggaaggagaccgcctcgtcgccgtgcagggtggtgacgaactccacgtcggcggacgtcagagccttctcgatcatcaatacgctcgtgaacacgactggcgccccttctgctgtgaaggcccgcgcggggccttctctcctccgctgggccgcgaggccctgcggaaaccatcctgccccgtaaccgcacggagtctgcgagatttagtgtgcccagcggcagcggaacggaacgggtgattccgctacgtgtcggccagggccggcggtaccggccccggacccgatggtcagcggcgccggtaccggccgaacagaaacccggcatcttccagcagggagacgagttcgaagcgggccggcaccgccaccgacggccctgaggcgatgcgctgcgcgtcgcccgcgacgagcatcggggagagggccagacacatctcgtccagcacaccggccgcgaccagctggccgagcagccgcgggccgccctccgtgagcagccgggtcatcccgaggtcgcccagggcacgtacggcgcgggccgggtccacgcccctgccgtccccggccaccaccacccgcgcgcccgccttctcggcggcggcgacccggtcggggggtgcggcggccccggtcaggacgagcgtgggcaccaaggccgaggtgaagagcggaagcgagaagtccaggtccaggctcgccgtcaccacggcgatcgcgggcgcggggccctgcccggccgccgcccgcagctccgcgaactccgcacgcgcgcgggccggccggtacccctcctgccgtaccgtttccgcaccgacgaccaccacgtccgcgagcccccgaagggtgccgaagatccgcatgtcggcggcgctggagatgggctgcgagcggccctcgtgctgggctgccccgtcgagcgtggtcaccatgttggcgcgcagccagggcgtacggccgccgggcccgcccgcggcgccggcccggggatacgcgtaggccgcggccagctcgtcgagcccccactcccggtccgccgcatccgcgccgggagcccctcccgaggcctgggctgctgtttcttccgtcacagggaacaggcgtcgcatgacgtgcagtgtggcacggcaactagagtggggaaccgtgtcgtcctccaccgccgcctccggtatcgatccgatagccgaagcggccccgctgtccctgtgcgcccgtgcgccgcacgtccccgccgaccggctcgtcgcggagatggtgccgccaccgcgcttcgactcggtccgcttcgccacctacatcccggacccgaaccagccgagtcagaccgaggccgtccgcgtcctcgaagacttcgccaccggtctgggcggggcgcacgcctccggttccggcaggcgcaggctgttcggcttcgggaaggccccgaagaccccggccggcccccgcggcgtctacctcgacggcggctacggcgtcggcaagacccacctgctcgcctccctctggcacgccaccccggccgagcccgagctgaaggccttcggcaccttcgtggagctgacgaacctggtcggcgcgctcggcttccagaagaccgtgcagacgctgagcggccaccggctgctgtgcatcgacgagttcgaactcgacgacccgggcgacaccgttctcgtgtcgacgctgctgggcaagctggtcgacgcgggcgtcgcgctggccgccacctcgaacaccctgccgggcaagctcggtgagggccggttcgcggccgccgacttcctgcgcgagatccagggcctgtccgcacacttccgccccttgcgcatcgacggtgaggactaccgtcaccgcgggctgcccgcggctccggcgccgtactccgacgagcaggtgacgaaggcggcgtacgccaccccgggggcgtccctcgacgacttcccgcacctgctcgagcacctcgcccgggtccaccccagccggtacggcgcgctgaccgacgggctcggggccgtgtgcctcaccgacgtccagccggtgccggaccagtcgacggcgctgcggctcgtcgtgctcgcggaccggctctacgaccgcgaggtcccggtgctcgcctcggggctgcccttcgaccagttgttcagcgaggagatgctgaacggcggctaccgcaagaagtacttccgtgcgatctcccgcctcaccgccctcgcccgcgacgccaaggggctcgtagcggcgtagcaaccccaaacacgtttgctgcatgggcgacttcaagccattcccacctcggcttttgggctcttctttacctgaaatgtaaagttaaccctgcaaacaacttaggcgcgttaacgtagtcaacgacgccgagtcgacgcagcgggagaggaggcgcatggtgcgaggtacgacggtccggttcgtgctgacgatcctctccaccgccctgctggccctgcaactcttcgctcccaccgcgtccttcgcggccacgcacagcgacacccacgcgtccgcccccacagcctcgggcggattcgtcgccaagcgcgcggacgaggtcgcctcctgcggcgagtccgaacaccctgcgggcccgaccggcccactgcgcacccgtgatcgccacggcgccgccgcgacctcggcctccgcgccccccgtgctggtgttcatgggatacggctcccccgccacgcaccccacggaggccggtgccgagtcgcaccgcacctccagatcctcgaccgcccactcccccgcggcacttcaggtgttccgctgctgagctgccccttcgggcacgaaccggcacgacccaccctcaccacgccacgtccgccgagcgcgtagacgtggggtcatgtcgtcgtacccgcatctgccatgttctcgtacgccgacgcgccatcgaggcgcgccaggaggaactgacaatgcagcccctcatcgatcatgcccgtgcgcacggacagcgccccgaggagttcgcccagctggccgagggccagtcaccgcaggccctgttcatcacctgctccgactcccgggtcgtccccgccctgatcaccggcgcccggcccggtgagctcttcgaactgcgcaccgccggcaacatcgtccccccgtacgccgcctcccagcaccccaccagcgaggcggccaccatcgagtacgccgtcgaagtgctcaaggtcaccgacgtggtcgtctgcggccactcccactgcggcgcggtcggcgccctggtgcgcggcgacgacctgaccgccgtacccgccgtgcgcgactggctcgcacacgcggctccccgcccggcaggcgcggtcgaggaccccgccgtcaccgaggcggtgcagagccacgtcctgacccagctgctgcgcctgcgctcgtacccgtgcgtctcggcgaaactgacgagtggtcaactacggctgcacgcctggttctacgaggtgcacaccggctccgtgctggcccaccgtccgcagaccgacaccttcacggccctgtgagcgccgccgtgcggtccccgaacaggttcctcgtgaagttcccccatctgcggcaggacttcgccgcttccctcgtcgtcttcctggtggccctgccgctgtgtgtcggtgtggccgtcgcctccggcgtgccggccgaactcgggctggtcaccggcatcgtgggcggcatcgtcaccgggctgatgcggggcagcagtctgcaggtctcgggcccggcggccgggctgaccgtgctggtcttcgaggccgtccaggagtacgggctgcccgcgctcggcgtcatcgtcctggccacgggtgcgctccaactcctcatgggcgccctgaagctggggcgctacttccgggccatctcggtctccgtcgtcgagggcatgctggccggcatcgggctcgtcctgatcgcgggccagctctactcggtggccggcgccaaggccccggcctccggcctgggcaagatcgccggtctgcccgaggcgctcatagcggcggcccggagcaccgaggcactcgcctcgctcgcactcggcgccgggaccgtcgccgtgctcgtgctgtggcggcggctgccgcgcaaggtgcgtacggtaccggcgccgctggccgcggtcggcctggccacgctcgccgccgcggcgttcggcctgccggtggcgaccgtcgaggtgaaggggctgctcggtgccgtccagccgccgtccctcaccgccttcggcgacctcgcgagcgtcggcctcctcgccacgatcgtcgccttcaccctgatcgcgtccgccgagtcgctgttcagcgcggcggccgtggaccgggctgcacgacggtccgcgcacccagtacgacaaggagctgatggcgcagggtgcgggcaacgcggtctgcgggctgctcggcgcgctgccgatgacggcggtgatcgtgcgcagcgcggccaacgtccaggcgggcgcgcggacgaaggcgtcccgtgtgctgcacggtgtctggctgctgctgttcgccgcgctgctgccgtccgtgctcgcgtacatcccgatcccggcactcgcgggcatcctggtgcacgccggcgccaagctcgttcccgtacgggcgatcgtgaccctgtggcgcgagcaccgcggcgaggcactgatcctcgtcgtcaccgcggtgtcgatcgtcgcggtgagcatgttcgagggcgtgctgatcgggctcgcgctggccgtcgtcaagacggcgtgggaggcctcgcacgtacgcctcgacgtcatcgacaagggtgccgggcccgtccaggcgtacctgtccggcaacgcgaccttcctgcggctgccgaagatcctcgacagcctggaggcgctgccccaggaccgcccggtcgagctggacctggccgggctgcaccacctggaccacgcctgccgtacggccctggagaactgggcccagcggcacagcggggccgggaccgagccggtgaaggtcacctccggttcctgacgccctcgggcccgccggtacccgtaccggcgggcccctcgcttctggggccccggcggaattatcgttgcaggagcagacatgaaggggcctctcgaggcatccgggggcctctcgaagaggaggtcgtcatgctccaggagctgctggtggcggccgtggcggccggttccgcgggcctcatatacgtcacggcggcggcgcgggtcgtcaagcagtacgagcgcggggtggtcttccggctcggcaggctcgcgggcgacgtccgtccgcccggcttcacgctggtggtcccgggcgtggaccggctgcgcaaggtcaacatgcagatcgtgacgctgcccatccccgcccaggagggcatcacgcgggacaacgtgacggtgcgcgtcgacgcggtcgtctacttcaaggtggtcgacgcggcgaacgcgatcatccaggtcgaggactaccgcttcgcggtctcgcagatggcgcagacatcgctgcggtcgatcatcggcaagagcgacctcgacgatctgctgtccaaccgggagaagctcaaccagggcctggagctgatgatcgacagtccggcgatcggctggggcgtgcagatcgaccgcgtggagatcaaggacgtgtccctgccggagacgatgaagcggtctatggcccggcaggccgaggccgaccgtgagcgccgcgcccggatcatcaacgccgacgcggagttgcaggcgtccaagaagctcgcggaggcggccggagtgatgtccgagcagcccgccgcgctccaactccggctgctccagacggtggtggcggtggcggcggagaagaactccacgctcgtcctgccgttcccggtggaactgctgcggttcctggagcgggcgcaggcccagcagccgcccacgcccgcggagtccggagccgacggcgcgaccggtaccccggcaggcaccggacacggcaccccggcctacaccggacccggcagcgcgaccgccaccggagccgacggcgcgaccggcatcgaatccggcccccgtaccgacacgggcaccgtccctcgcaccgacaccggcaccggcacgtgacacgtgcgacgcgcgtggttccggtgatcctgatgccgtgatacacacggctgggtcacagtcctgtccgccaacaggaaggttgccccatgcccgaaaacggtcgccccgcatcgcgacgtcaggtactggcccgcagcggcgcgttgggcgtctcgatcgccttcgccggaaacctctccgagctcttcgcgggcaccgccgccgcacaggacctcggccaccggggctatggcccgctggtccccgacccgaacggcctgctcgacctgccgaaaggtttccgctaccgggtcctgtcccgcgagggcgacccgctccgctccggcgagggcccggtccccagcaaccacgacggaatgtcggcgttcgcgggccgccacggccgcgtccacctggtgcgcaaccacgagaaccgcgtcaccgcgaagttcccggtcccgacggtcgagggcctcacctacgatccgacgggcaagggcggctgtacggcgctgacgttggacgggcagggccaggtgctctccgaacgcgtcgcgatcgccggtacggcggtcaactgcgcgggcgggcccaccccttggggcacctggctgacctgcgaggagaccgaggacagggccggcacgaacggctacaccaaggatcacggcttcatcttcgaggtcgacccggcgaacccccaccgcaccggcgccgtaccgctcaccgcgatgggccgcttccagcacgaggcgatcgccgtcgacccgagacacggcatcgtctacgagaccgaggacgcgttcctcaagcccttcggcctcttctaccgcttcctgccccaccggcccgagggcggcgtcggttcattgcgcgccggcggccggcttcaggcgatgcgggtgcccggcgtacccgacctctcctcggtccaggagacgggcgcggccttcgacggcgtcgagtgggtggacgtaccggatccactggccgcccaaaccccggtcagactccaggacttcggcccgaagggcatcacccacgcacagaagctcgagggctgctactggggcggctcgtgcgtgtacttcgtctcctccttcgcccgcggcgcggacggctcggccgctgaccactacgggcagatctggcgctacgacccgtccgcgcgccggctcaccctcgtgatcgtcttcggcccggacaccgacgtacagctcccgggcgagtcaccggacaacatctgcctcgcacccggcggcggtctgatggtctgcgaggacggcaacggcgcgcagcacgtcttcggggtgacgcggcgcggcgaggtgtacgccctggcccgcggcgcccagaacatcggcacccccgaggctccggagtggggcgagttcgcgggcgtcactttctccccggacggccggacgatgtacgtgaactgctacacgcccggtacgaccttcgcggtgacggggccctggcgcaggtgaggtgccctcggcgggccgggccgcggtacggcacatgccgcccggcgcgctgaccgccgactcgagtccgaagccccggggcaagcgccccggggcttcgtcgtgaggtcgtggggcccgcttcctcgcaccggtacgcccctgacgcacagccggccgggtggcttcgtcgtcgtcttcgcacggcacgtgccctcggtgggcgaataatcacatttaccccgatatctttatccggtgatcattcttgtacgccgtgtcgccgtcgccggtgccctgggcgccctgggagccgcgctcgccgcctgcggcactcccggcgcatccggcaccccgcacgccgccgcacgccctgcgcactcggcgcccaccaccgccgcgtcctcgaagccccccaccctcacgcccggcccctccgggctgacccccgtcttcaagaacggcccgcgcacgcagggcaagaccgtcgcgctcaccttcgacgcggacatgaccgcggatcagggcgcgcgggccgccgccggggagcatttcgacaatccgcagttgatcggcgcactgcgcgagctcaaggtgccggccaccgtgttcatgacgggacggtgggccgacgaatacccccaggaggcccgggccatcggccgcgaccccctgttcgaggtcgccaaccactcgtacagccactacgccttcacaagcgactgctacggcctgccgaccgtgtccgaggaccggatgcggtccgatgtggagcgggcgttcgccgccttcgagaaggcgggggtgccccacgtgatgccgtacttccgcttccccggcgggtgctacgaccagcgtgcgctgcgcacgctgatccccgtcggcgtcaccgcggtgcagtgggacgtggtgagcggggacgcgttcgcgacggacgcggacgccgtggcccagcaggtgctggagggcgtccggccggggtccgtcgtcgtcatgcactgcacacggagcgcggccccgacgacggagcgggccgtacggacgatcgttcccgagctgcgcaagaaggggttccggttcgtgaaggtgtccgagctgatccaagcggcctcgggcgggcgtcgataggcggccgaacggcctgtggcagcggttcacaccgagcggcttacgctgggagcatgagcggcgactactgcggtacggagacggcgggcccggcacccaaggcgggcggtccgccgttcgccgcgtgtgtgctgtgccaggagccgacggagtacccggagtcgtacaaggggatcacgctgtgccccgtctgcgcgtggcaggaggcacagcgcggcgcctgctcaggatgagcgacgggccgtgcggggagccgcttccttcccccacgaagacccgatcttcggcctggcagactggagggcgtgaccagtgatcccacccccgccacccccgccacccccgccaccccggccgccccggccgtcgacggcagcgctccgcaggacagccccttccgctccgagcgcacctcccgtgacgaggcgcggcagttcgtgctgccgctcgtcgtgcgcatcgagaagtccgctcccccggcgcgcacggacgcgctggagacggcggcgcgcgcggtgctcgtcatcctgagcgacgagcggtcgctgggcgacggggagtgggcgcaggcgatgacggactggcaggacgcccggatccgcaaggtggtccggcgggcgcgcggcgcggagtggcggcgggccgaggccctgcccgggatcacggtgacgggcaagtcggcggaggtacgggtcttcccgccggtaccgctggacggctggcccaaggacctggcccgtctccaggtctccggcaccgacctcgaggattttgaaccgcccctggaggcggacccttccgccccggtcctccggctgagccccgacctcgacatgtcggcgggcaaggcgatggcgcaggcgggccacggcgcccaactcgcctggtgggaactgtcggacgaggaccgcgcggcctggcgcgacgcgggcttcccgctcgccgtccgcacggcggacccgtcccactggcgcgaactcaccgcctcaggcctcccgttggtccgcgacgcgggtttcacggagatcgcccccggctcgtgcacggtggtggcggaccatccggcactgcgcggctgacgcctccggaggtcacctgacccggccgctcgggcggacgccggagcggtggactttgccgagcgaacagaaatctttgcccaaggcttgaacatctcgacagcaccgtacgtacatcccggcactggccaagcacagacgcccaacgaccagttggtttcatccgggaggcacactttgcggcgtatcaacggcaccgccctcgtcatcgcggcactcttcgccaccgtcggcgcgctggcgtaccccgtgtggtcgtacgccgaccgttccggaaccggacaggcgaacctcgccgccgggacggtgagcacgcgctgggggccgctcaccgcctccgaccgcgacctgatcgtccgggtgcgactggccggcctgtgggagctgccggccggacagcaggcgctcgagcgcccggtcagcaaggcgttcaaggagacggccgaccacctcatcgtcggccacaccgatctcgacaagcgggtccggatcgtcgcggcccagctgggagtggagctgccgaaccagcccaacccccagcagcagggctggctccaggagctgagcgcggccagcggcaaggagtacgagtacaagttcgcgaacctgctgcggtccgcccacggcaagatcttcccggccatcggcgccgtccgtaacagcacccgcaacaccctggtgcgccagctcgcctcggacaccaaccagaccgtgctcgaccacatcacgatgctggagaagaccgggtccgtcgacttcgacgccatcgccaacgacacggcagccgccgcgaccgccagcccgaccggtcccccggccccggtccccggttcgacggcggcctcggcgccgcccgccgaggcgaccggtgacgtgcaggtctcgtcgtctccgtcgccgggggagcctgggacggtcaacacgggccggccggatcccgaggactcggacaacgtgttgcagtagcggcatcgcgcccggccccgcggccgctgcggccgggcgccggccgggcatcggcccggcggaacctcaaatgttcctctgaacgtccccggggcggggttcggccccgagggcacgggccatgacaccgtcacgccggaacagcgggcccgtcgagggagacggggcagcggagtcctggtgaagccgtggtggaggaggggacgatggagcgactgaggacactggggacactggggacggggatcggctggcggccggagatcgcggacgccgtggagcggatgccgggcatcgactgggtcgaggccgtggcggagaacgtgtgccccggacatctccccgagtcgctgctgcggctgcgggcgcgcggcgtcaccgtcgtcccgcacggtgtctccctcggcctcggcggggcggaccgtcccgacgagggccggctggccgccctcgcggagcgcgccgaggcgctgggctcgccgctggtcacggagcacatcgccttcgtacgcgcgggcggggcactgaccgcctcgcccctgctggaggcggggcacctgctgcccgttccgcgcacccgcgacgcgctggacgtgctgtgcgagaacgtccgcatcgcgcaggccgcgctgcccgtgccgctcgccgtggagaacatcgccgcgctcatctcctggcccggcgaggagatgacggaggggcagttcctgtacgacctcgtcgagcgcaccggcgtacgcctgctgatcgacgtggcgaacctccacaccaaccacgtcaaccggggcgaggacccggccaaggccctggacgagctgcccgtcgaggccatcgcgtacgtccatgtcgcgggcggcttcgagcgcgacggtgtctggcacgacagccacgcccaccccgtcccgcaaccggtcctcgacatcctggccgacctcgcctcccgtacgaccccgccgggcgtactcctggaacgcgacgagaacttccccgaaccgggcgagctggagcgggagttgggggcgataaggaagacgttggagaaggcggggacgagggcgggggcttcggccggagccgcgggggccgcgacgaggacggcggcggagcttacggtggcggagtcgacggcggtcggcgcgatcgccggcccgaggcgtggcggtgccgacgcgcaggccgcgcctcgggcggccgggaccgaggccctgagcgcggcgtcgacgtcgacgcccgccgaccccgcccgccagcgcctcgcgctcgcccaggccgctctcctctccgccctcgtcgccggcacccccgtacccgaggggttcgaccgggtacggctgggcgtgcaggcccgtgccctcgccgccaagcgggcggacgtggtcgcgaaggtcgcgccggagttgccggagatcctcgcggaggagtaccggccggccttcctcacgtacgcccccgggcacccgatgaccggcggctaccggcgtgacgccctcgacttcgccgagcacctgctgctcgccgggcgccccgaggacgcggaggcccggcgccggctgcgcgactggtggctggagcgctccggccccaccccgccctcccgacaccccgccgcccgcctggcccgcgccacccgcagggtcctgctgcgccgctgaggccgttgcgtcgctgaggccgttgcaccgctgaggcgccgttgcgtcgctgagccctgtgcgccgcgcggtccccggcccggcatcccgaaggccaccggcacgcaggaccccagtacgcccaccgcaacgggacggcaaccgcctccacagaatgtgccgcggttaacatcgcggctccttcgcatgcccacgggattcatttgcaccgtttcaccgtggattgccctccaccgcccctaccgcgtccgggtccctccgccccgtaatccaccccttcctccctgtacggcagttggcgtagtccgcgcagtaatatgccaagccgcacccgaagcgcactagcgtgcggtgccgcaagcaggaggcacaccgacatgcgatccatcaaccacaccggactgttcagtggcaccggactcatcatcgccgggctgaccgcgaccctcgtcgcgctgatctttccgatctggtcgtacgcggaccgctccggcacaggcctggacaccctgagcgcccagaccgtgtcgacgaagttcggcccgctgtccgccctggaccgggagttcgtcacgaaggtccggctggccggcctgtgggaactgcccgcggggcagcaggcacaggacaagggcaccacccaggccgtgcacacggcgggcgagcacctcgtcgagggccacacgttcctcgacgcccgggtccgcaacgtcgccgcgcgtctggggctcgagctgcccaaccagccgaacccacagcagcgtcagtggctcgccaccctgaactcggcgcagggcgagacctacgaccgggacttcgccaacatcctgcgccaggcccacggcaaggtcttctccgtcgtcgcccaggtccgcgcgggcacccgcaactccctggtgcgcgacctcgccgacgacgcgaacaccaccgtcctcgaccacatcaaggtcctcgaggccaccggcctggtcgacttcgacgcgctggcccgggacgcggccacctccggcccgcccccgctcaccagttcccccgccccgccgggaccgaaggcctcaccgaactccccgattccggtcaccccctcgccgacctacaccctgccgcccgccgcctccagccccaggccctccgaaaagaactgaccagcgccggaacggcaccaacccgctcccggtacaacgcccgcacgacgcccgtacgacgcccgcacgacgtcaaacggaacgtcacataccgacaacgctccgtccatatcgtggaaaccccgtggcgctcgggcacctgttcgcatagaaaaacgccatgttctgggtccttctcctgctcctggcgtgggtcgccgccggcacgtcctgcacacgcctgtgcctggccgccgtacgcgccgcggccgtcgacgcgaacgccgcgcgcggccacgccctgacgctgtacgaggcggcgttcctggccggcggcccgaagcgggtggccgatctgacgctcgtcgcgatggcccgtcagcggcggctgctgctcgcgcacaccggctgggcgaccgtcgtggaccccaacgggcgggacgagatggagcgttcggtgctgggcgcgataggcccggaggggcagtcgcggatagcgccggtgcgccggacgaccgccgccgccgaccccgtgcgctcgctcgccgaccggctcgtcacggcgggcctcgccgtgcccgacggcgcgcgtacgaccgtcgcgggcgccgtccgccaggtgcaggccgcgtccgcggccgtcgccgcgctgggcgcggtcgccgtactgatgcccgcggaggccgccgaggagcagatcccggtcgtcgtctggttcgcgctgcccctgctcctcacgctgagctgtctcgccatcgcccgcgtcgaggtccacccgtacacgcgctgggcgtcgccggccggccagcggctgctcggcgccctgccccggcacgccgacgaagccggcgacgaccgtacgtatctcacctccgtcgccgtacgcggcatccgcgcgatcggcgaaccggagctgcgcgccgccttcacccaccgggagcgcggctgacggcccctcaccgatcaacggccctcaccgatcaaagggacgcccgatgagagccgccgccccctgcaccgccgccgggtccttgctcctgacgggcctcgccgccgcaccggcgggcggcgtacccgccgcgccgggcgaccccgaactgcgcggcaccgtcacggtcccgctcgaccacgcgcgccccggcggcatgcccgctggtggctgtcaggcgagccccgccaccagctccgccaccgacttgcgacgccccgtgtagaacgggacctcctcgcggacgtgcatacgggcctcggaggcgcgcaggtggcgcatgaggtcgacgatgcggtacagctcgtcggcctcgaaggccagcatccactcgtagtcgccgagggagaacgaggcgaccgtgttggcgcgcacgtccgggtagccgcgggccatcttgccgtggtcggcgagcatgcggcggcggtcctcgtcgggcagcaggtaccagtcgtaggagcgcacgaaggggtagacgctcacgtagttgcggggcgtctcgtcggcgaggaacgccgggatgtgcgagcggttgaactcggcggggcggtgcagcgccatgttcgaccacaccggctccagggcgcggcccagcttggtgcggcggaagaggttgtacgcctcctggagctcgtcgctggtctcggcgtgccaccagatcatgaggtcggcgtcggcgcgcagccccgacacgtcgtacgtaccccggatggtcacgtccttggcggcgagctggtcgaacagctcctggacctcgtccgcgtaacccgcgcggtcctcgggcagtacgtccttcagcttgaagaccgaccacagggtgtagcggatgacctcgttgaggtccttggccagcttgcccttgttcgggatcctgccggactcggtggtgggggcgtcgtcactcatggggctattctcccgctccgccgtgcaggctctgcaccgggtgggcactcagctcgtccagccccgcgcggtcgccgcccagctgctccacggcggcgtacgcgccggcgatgcaggccgggatgccgacgccgtcgtacgccgcgccgcagacggcgaggccgggcagcttggcgacgtggtcgcggatgcgggccacgcgcgcgtggtggccgacggggtactgcggcaggccgtcggtccagcgggtgacgcggctggcgaccggcgtggcggccaggccggtcgcctcgcgcaggtcgtggcgcgagacgtccacgaggccggcgtcgtcccggccgaggatctccgtctcgccgtaccgcccgaccgacgtgcgcagcaccagcaggtcggggtcctcgtccgcgatccagccccacttctgggaggcgaacgtcgatgccttgatggtgcgcccgtcgacgggaggcacgaggaagccgctgccttcggggaggctggtcccactgcggcggtaggcgagggtgaccagcgccatggacgcgtactcgacgccggccagctcggccgcggcggcgggtgcctcggcgcgcagcagctcggcggcggccgcggcgggcagggcgacgaccacggagtcggcgtgcagcacacgaccgccggcgaccagccacccacgcggccggcccgccctcggctctgcgcagctcggtcacccggcgccccggtgacgatctcgccgccccgcgcgcgcaccgactccgcgaccgcgagcggcagttgcccgacgccgccctcgatgcccatgaagaccgggcccgtctgctgggccgcggccgccttctcctggagctcgcggaccacctccgtcagcgacgcgtgcgcgtggatcgcggtgaagagctgggggaccgccgagcgcatcgagaggcggtacgcgtcgcccgcgtacaccccgcccaggaggggctcgaccaggcggtcgacgacctcgcggccgaggcgcgccgccacgtactcccccaccgccacgtcgtcgccgacctccgtgcggggcaggtcggcgtcgcgctcgatgcggcgcaggccctcgtcgctcagcacgccggccagcgcggacgccgtgcccgggacgcccatgacgtggcccttgggcatggggcgcagggcgccgcgggtccagatcgacgccgaggcggtggccggggggcggaggcggtcggcgaggcccacctcacgcgcgaggcccaccgcctcggggcggcgcgcgagcatcgactcggcgccgaggtcgacccggacgccctcgatctcgccgggcagcagcttgccgccgaggcggtccgacgcctcgagcacggtcacgcgcgcgccacggtccagcagccggtgcgcggcggccagccccgcgatcccgcccccgatgacgacgacctgccccatacccgtgcgcgtctgagttgtgctcatgtccccactttgtcagacctcactgacagtccggccgggggccggtgacctgggtgagtccggaccgtgaccgcgccgggaccagtgtcctcggcgagtcccgaccgtgatggcatcgggaccggatccggccaacgttcctggcgggccgggcgtcgaagaagcgtcaggcacgacgacttccgggggtagcccacatgcagacagcacgcaccgtacgacctgttcgggtcctggcggccctgcttttgacctccgctctcgcgctcgcggggtgcagcgccgccgacgacggcggcggcagcagctcggacgcgaaggccgccgctccgggcgcccaaaaaggcgcggccgacagcggctcggcgagcggcgccaaggcctccggcgcgcccaagctcaccgcgagcgccatcatccgcaccgcctctctgacggtgcaggtcaaggatgtgcccaaggccctcgacgacgcgcgtacgaccgtcgagacggcgggcggcttcatcggcaacgagagcaccagccgggacgcgcggggccacgagcgcacccgtgtcgtcctgcgtgtgcccagcgagaagtacgaccaggtgctcggtgacctggagggcacgggcaagctcatcgaccgctcccgtaaggcggaggacgtcaccgaccaggtcgtcgacgtggagagccgcatcaagtcgcagcgcgccagtgtcgcccgggtccgcgagctgatggacaaggcgaccaagctcagcgatgtggtcagcctggagggggagttgagcagccgtgaggccgacctggaggccctgctggcccagcaggcgtccctgaaggaccgcaccagcctggccaccatcacgctctccctgtccgagaccccggtgaagaaggcggcggccaaggacgaggacccgggcttcctggacgcgctcgcgggcggctggcacgtcttcgtcacgctgctgcgctggatcgccctggcgttcggcgcggtgctcccgttcgcggcggtcgcggcgctggtggtgttcgtgtgggtgcggctcgtacggccccggctgccgcgccgtccggccccggcgacgaccgccgcaccgggtgcggttcccggcttccccgcgccctcgccggcgcccgcgcagcggcccgcggagggacgggaagagcactgaccggccccggccccggccccgtagcgtgttcgtatgagcatgagccgtacgagccgtacgaaagagcgcctggtcgtgatcggcggcgacgcggcgggcatgtccgccgcgtcgcaggcacgtcgcctcaagggccccgccgagctggagatcgtggcgttcgagcgcggccacttcacctcctactcggcgtgcgggatcccgtactgggtgggcggcgacgtcgccgaacgggatcagctgatcgcgcgcacccccgaggagcaccgggcccgcggcatcggcctgcggatccgtacggaggtcacggagatcgacgccgagggcgcccgcgtgcgctcccgggacctggcgtccggggccgagtcgtggacgtcgtacgacaaactcgtgatcgcgaccggcgcccggccggtccgcccggagctgcccggcgtcgacgcgcccggggtgcacggggtgcagaccctggacgacggccaggccctgctcgacacgctggccgccacccggggccgtcgggccgtggtcgtcggcgccgggtacatcggcgtggagatggccgaggcgctcatcaaccgcggctacgaggtgaccgtcgtcaaccgcagcaaggagccgatggccaccctcgaccccgacatgggccgcctggtgcacaaggccatggagggcctgggcatcaccatggtgaacgacgccgaggtcaccgggctgccgacgggagacgacggacgggtccgcgcggtcgccacggaggacgccgagtacccggcggacgtggtggtcctgggcatcggcgtacgccccgaaacgacgctcgcgcaggccgccgggctgccgctgggcgagcaccacgggctgctgaccgacctcgcgatgcgggtgcgcggccacgagaacatctgggcgggcggcgactgcgtcgaggtcctcgacctggtctccgggagcgaacggcacatccccctgggcacgcacgccaacaagcacgggcaggtcatcggcgccaacgtgggcggcgggtacgccacgttccccggtgtcgtcggtacggcggtcagcaaggtctgcgacctggagatcgcccgcaccgggctgcgcgagaaggacgcgcggcgggcggggctccagttcgaggcggtcaccgtcgagtcgacgagccgcgcgggctactacccgggcgccgatccgatgacggtgaagatgctcgccgaacgccgcacggggcggctgctcggtgtgcagatcgtcggcggcgaaggcgcgggcaagcgcgtggacatcgccgcggtggcgctcaccgcgggcatgacggtggaacagatgacggccctcgacctcggctacgcgccgccgttctcaccggtgtgggacccgatcctggtggcggcgcgaaaggcggtggcggcggtacgcgccaacggtgtgtgaggcacgcgccccgagaggggcgcggacccgcgacatcacgcggctcggcggcccccgctatgccgactcgtgctgaccggccgtcccgttgatccgctcgatggcctgccgagcctgttcggccggcggccgcggcgacagtgcggacacggacgcggtggacggcacggcgggcggctgcgcccccgccggcttcgcatgggaggcagggcggttggagcgcagccgatggctgacggcctcgtcgatggtcaccgggcgctgcatcttggcggcgagccggccggcctcctggccgagcagggcgacatcctcccagggcagatgcagcaccagggcgacctccgcctccccgtcgggcagggcgtgtatcggaggagtaactcgctcgttcatcgcctgttcctcacgtagttgccggcatcgcgggcggttgaggagacatacgtacgaccgtccggtcgcgttcaccggttcgccgggctcatccagggcactactttcttgtggtcattcccgtccatgacgtgaacccggtacagcgcacgccctatgtgacgtatgcgctgatcgcgatcaacttcgccgtcttcctcttcacccccggcatagcgggatcggtgacgggagacagcggggtgtcgcagctgtgtcatctccaggcgttcctggaacgctacgcggccgtgccacaggagttgatccaccaccagatgccgcggctcgtgccgacgggcgaggtgggcatcggcccgcagggccccggctgtgtggccgcgccgccggactacgacaagtcgcccccgctgtcggtcctgacggcgatgttcctgcacggcagctggctgcacctgctgggcaacatgctcttcctgctgatcttcggcaacaacatcgaggaccgcatggggcatgtgcgcttcacgctgttctacgtggcctgcggctacgtggcggggtacggcttcgcactcctcaacgacgactccggggacccgctgatcggcgcctccggggccatcgccggtgtcctgggcgcgtatctggtgctctacccgaaggccagagtgtgggtcctcgtcccgttcctggtgttcctgccgctgcggctgcccgcgtggatcgtgctgggcttctggttcgcgctccaggcggtctactcgtcgggcggcgcggtctccacggcggggacggtggcgtacgcggcgcatgtggtcggcttcctcgccggcatgctgctcgcctggccactgcgcccgggcacaccgccgccaccggcgccgcgcagcctgctgtggggcaggcaggcgcggcacacctggtgacctcggccggtcagcgggcggtctgcgtgtggacgtactccacgaggcgggtcagcgcgtccgggtcggtggtcggcgggacgccgtggccgaggttgaagacatggccctcgagaccggcggccgcatcaagcacctcgcgggtcttggtctccaccgcctccgtcgtggagaacaggaccgccgggtcgaggttgccctggagcgccttcccggtgccgacgcggcgggcggcctcgtcgagcgggacgcgccagtcgacgccgacgacgtccgcgcccgcctcgcccatgaggccgagcagctcaccggtgccgacaccgaagtggatacggggcacgccgtacgactcgacggcctggaagaccttggtggaggcgggcatcaccgagcggcggtagtcggcgggggcgagcgcgccgacccaggagtcgaagagctggacggcggaggcgcccgcctcgatctggaccttgaggaaggccgaggtgatctcggcgagacggtcgaggaggtcggcccacagctgcgggtcgccgtacatgagcgccttggtgtgctcgtggttcttggacgggccgccctccacgagatagctcgcgagggtgaagggcgcgcccgcgaaaccgatgagcggggtctcgccgagctcggccgtcagcagcttgatcgcctcggtgacgtacgagacgtcctcgggggtcaggtcgcgcagctgggccaggtcggcgcgggtgcggatcggcttctcgacgaccgggccgacgcccggcttgatgtcgaggtcgatgccgatggccttgagcggtacgacgatgtcgctgaagtagatcgccgcgtccacgttgtgccggcggaccggctggagtgtgatctcggcgaccagctcggggcgcatgcacgactcgagcatggggatgccctcgcgcaccttgaggtactccggcagcgagcgcccggcctgccgcatgaaccacaccggcgtgtgcggcacgggctcgcgcctgcacgccttgaggaaggcggactcgtacgtggctgtcggctggcccgtcgcggggcggtcgttggcactcacgacggaaagtctcgcacgccccaccgacagccccgcccgggcccgggccccgaaagggggcggggggtgaagggggcgggggcgaagggggcggggggcgcacattcgcacagcgcgatccggacagtggcccttcgcacgggtgtccctccctgcacgagcgcttccttccccttaatcttccccgcatggctgcggctcagggacgactgtcggacggcgctggcggaatggacgacgcgaaggagggggaccgggatgggacggagacggctccgctgcccttccgcgcctctgtcgaggcactgagggccgcacgactgcggccggagatcgagatcgacccgacgcggccgccccagcggctcgccccgtacgcgtacgcgctggaggccgccgtcgtcgaggacgacgaggacctggccgacggccggctcgtcctgctgcacgacccggccggacacgacgcctggcagggcacgttccggctggtcacgctggtccgcgcggagctggagccggagatggtcgcggacccgctgctgccggaggtgtgctggtcctggctcaccggcgcgctggaggcccgcgggctgtcgtacggcgaaccgagcgggacggtcacccgcgccagttcgcactacttcggcggcctcggcgagcggccggccgcgtcccagatcgagatccgcgcctcctggaccccgcgcgagggcctgggcggcgtcccggacacggccgcccacctcgcctcctggtgcgatctcctgtgccagatcgcgggcctgccgccgacgggcccgggcgccgacgcctccgtggtgacgctgccgcagcggcgggggccgcagtcccgctgacccgacgaccccgaggggcggccccgcgaaagcgggagccgccccttcgtgcgcaccggtccccgccgcttgtcccacggtcgcggccctctcgctgaccttttgtcgatacgaccactttctgacccgttatgacgcggagcgaaccgattcgatcttcgggtgatcgctcgcgcgtccgaattgcccatattgttactcaccaaatcgtgatcattctctaaaggaccacgggtttgatgccgaagacctctgtgaccttgaaagcacggttcgtcccggcttcatccccagagccggccccgtccccgcaccccaggaggcctggtgtccgttctcctcgagcagcccgcaagcctggtcgcctaccgcccgaacaagccgaccgccatggtggtcgtggccgacccacgggtccgctccaccgtcacccgccacctctgggcgctcggagtgcgcgacgtcatcgaggcgtcgtccgtcgcggaggcccgtccccgtatcggcaacccgcgtgacatctgcgtcgccgacgtccacctgccggatggttccggcctcaccctgctgtcagagaccagagccgccggctggcccaacggcctcgctctttccgccgccgacgacatcggcgccgtccgcaacgccctcgcgggcggagtgaagggctacgtcgtcaccggcacgcggacgaatctgggactgcccacccggcccggcgccgcccccatcggctccgccgccgcccgtatgcaccgccgccccccgggtgccccgagccacccgggcggctaccgcgaactgtccggacgcgaggtggaggtgctgcgcctcgtcgccgagggccagtcgaacaaggccatcggcgtctcgatgggcctgtccgcactgaccgtcaagagccacctcgcccgcatcgcccgcaagctcggcacgggcgaccgcgccggaatggtggcggtggccctgcggaccgggatcatccactgaccgcaccccttgacggcacccactgaccacaccccctgaccactcccattgaccgcatccgccgatcacaccgccgatcgcatccgccgacgcgctgcaccgaccacatgcaccgaccacattcactgacacgtgtgacacgtgactggtttacgacccccagacgcccgtcgacggaacgttccgtcggcgggcgttgtccatacacagatacccttgacaggtgaccgacgcccaagagaccgcagcagacagctcactgcgaaccaccggaggcgcccctccggacgacgtcgaaacggcgccgaccccgttgctcgagccccgcgagggcattccgcccgtgattgccgacgacgcctcgctcgccgaggtgatcgccgccttcgccgccggcagcggccccgtggccgtggacgccgaacgtgcgtccgggtaccgatacggccagcgcgcctatctggtgcagctgcgccgcgagggcgccggcacggcgctgatcgaccccgtggcctgtcccgatctctcgggcctcggcgaggcgatctccggcgtcgagtgggtgctgcacgccgccacccaggacctgccgtgtctgcgcgagataggcatggtgccgacgcggctcttcgacaccgagctggccgggcggctcgccgggttcccgcgggtcggcctgggcgcgatggtcgagagcgtcctcggcttcgtactggagaaggggcattccgccgtcgactggtcgacccggccgctgcccgagccgtggctgcgctacgccgccctcgacgtcgagctgctcgtcgacctgcgcgacgccctggagaaggagctggaccggcagggcaagctggagtgggcccagcaggagttcgacgcgatcgcctcggcgccgccgccggagccgcgcaaggacccctggcgccgtacgtccggcatgcacaaggtgcgccggcgccggcagatggcggtcgtacgggagctgtgggagacccgggaccggatcgcgcagcgccgggacgtctcgccgggcaaggtgctcggggacacggcgatcgtcgaggcggcgctcgccctgcccgcgaacacacacgccctggccgcgctgaacggcttcgggcaccgcatgggccgccggcagctggagcagtggcagaccgccgtcgaccgggccagggcactgccggacgccgagctgccgcagcccggacagccggtgaccggccctccgccgccgcgcgcctgggcggacaaggatccggccgccgccgcccggctctccgcggcccgcgccgcggtgtcggcgctcgccgagcggctgaacatgccgcaggagaacctgatcacgccggacaccgtgcgccgtgtgtgctgggagccgccgaagctcgcggacgccgactcggtggcggccgcactcgccgcccacggggcccggccctggcagatcgagcaggtcacgccggtactggtgacggccctcgccgcaccccccaaggcctgaggctcacttcgtcacggcccgcgtgaacccgttgcggatgaaccgctggaggaacaggaagacgatcaaggtcggcaggacgacgagcaccgcaccggccgagatcgtcccccagtgcgcgccgaacggccccctgaagcggaacagcgacgtcgagatcacgccaagatcctcggtcggcgcgtagcggaaaggcgggcagaagtcgtcgcagacggtgaaagcgtcacgaccacgggtggcgcgttctgtgcggacgcggcgggtacgtcgttcgaggtgatcacggggtgaggggtcgggctcgcctccggtgcccactcccgtcctggccccgggagggtccacggcacccccgcggatgtgaccttcaccgctcccgcctccggggctgggcagcatggttactcacaagtagcatggagaggtgagcgcgcgctcagtcgcgtgcgccgcgcagcagtgccaccccgcaccctggaggagagccatcgtgcctcgtaccgtcagggatgtcgtcttcgtcgacggcgtccgcaccccgttcggcaaggcgggcccgaagggcatttaccacgagacccgcgccgacgacctcgtcgtgaaggcgatccgggagctgctgcgccgcaacccgggtctcgacccgaagaagatcgacgaggtcgccatcgccgcgaccacccagatcggcgaccagggtctgaccctcggccgcacggccggcatcctggccgggctcccccagtcggtccccggctactccatcgaccgcatgtgcgcgggcgcgctgaccgccgtcaccgccacggcgggctccatcgccttcggtgcgtacgacgccgtcatcgccggtggtgtcgagcacatgggccgtcacccgatgggcgagggcgtggacccgaacccgcggttcgtcagcgagaagctggtcgacgagtccgccctcttcatgggcatgaccgccgagaacctgcacgaccgctacccgcacatcaccaagcagcgcgccgacgagtacgccgtgcgctcgcaggagaaggccgccaaggcgtacgccaacggcaagatccagcaggatctggtgccggtctcggtgcgcaacaccaacgcggaggtcggtgagaccggctggggcctggtcaccgccgacgagccgatgcgcccgggtacgacgctggagaacctggccggcctcaagacccccttccgcgtccacggccgggtcaccgccggtaacgcggccggtctgaacgacggtgcgaccgcctcgatcatcgcgtccgaggacttcgcccgcgagcacaacctcccggtcaagatgcgcctggtctcctacgccttcgcgggcgtcgagccggaggtcatgggctacggcccgatcccggcgaccgagaaggccctcgccaaggccggcctgtcgatcgaggacatcaacctcttcgaggtcaacgaggccttcgccgtccaggtgctcgccttcctcgaccactacggcatcgccgacgacgacgcgcgcgtcaaccagtacggcggcgccatcgcgttcggtcacccgctggcctcctccggcgtgcgtctgatgacgcagctggcccgccagttcgaggagcagccggaggtccgttacggcctcaccaccatgtgcgtcggcttcggcatgggcgccacggtgatctgggagaacccgcaccacaaggacgccggaggcgacaagtgagcaccactgaactcctgaagggtgcggccgcgctgttccccgacgaggtcgtgacgtccgcgcacgtacgtcacctcgacctgccctccggcgccgggcgcttcgcgctcatcacgctggacaacggcttcgaccacaccaagccgaccaccttcggcccggcgtcgctggcgaacctcaacaccgccatcgaccaggtcgagaaggaggccgcggccggcgagatcgtcggtgtcggcatcaccggcaagccgttcatcttcgcggtcggcgcggacctcaagggcgtcgagctcctgaagaaccacgacgacgcgctcgccatcggcaagggcggccacgaggtcttcaagcgcctcgcgggcatagcggttccgaccttcgcgtactacaacggtgccgcgatgggcggcggtgtcgaggtcggtctgcactgccagtaccgcacggtctcggcggcgctgccggcgttctcgctccccgaggtcttcctcggtctggtccccggctggggcggctgcacgatcctgccgaacctgatcggcgcggacaaggccgtctcggtgatcatcgagaactcgctcaaccagaacaagcagctcaagggcgagcaggtctacgacctcggcatcgccgacgcgatcttcgagggcgcggacttcctggagcagtcgctgctctggacgacggccgtcctcaagggcgagatcgccgtggagcgtccggagatcgaccgcggcgaggcctgggaccaggccgtcgccaagggccgcttcatcgccgacagcaaggtgcacggtgcggccccggccgcctaccgcgcgctggacatcatcgccgccgccaagaacggcgacctccagcagggcttcgacgccgagaaccaggccctcgccgacctcatcatgggtggcgaactgcgctccggcatctacgccttcaacctggtccagaagcgcggcaagcgcccggcgggtgcgccggacaagtcgctcgcccgtccggtcaccaaggtcggcgtcgtgggcgcgggcctgatggcctcgcagctggcgctgctgttcctgcgccgcctcgaagtgcccgtcgtcctgacggacatcgaccaggagcgcgtcgacaagggtgtgggctacgtccacgccgagatcgacaagctgctgctcaagggccgcgtcaaccaggacaaggccaaccgcctcaaggcgctggtctccggtgtgctggacaaggccgagggcttctccgacgcggacttcgtcatcgaggccgtcttcgaggagatcggcgtcaagcagcaggtgttcgcggaggtcgaggcggtcgccccggcgcacgcgatcttcgccaccaacacctcgtccctctcggtcaccgagatggcgtcgaagctgaagcaccccgagcgggtcgtgggcttccacttcttcaacccggtcgcgatcctcccgctcctggagatcgtccgcggcgagcagacggacgacgcctccctggccacggccttcggtgtcgccaagaagctgaagaagaccgcggtgctggtgaaggacgccccggcgttcgtcgtcaaccgcatcctcacccgcttcatgggcgagatccagaacgtcatcgacgagggcacgccggtcgaggtcgcggagaaggcggtggagcccctgggcctgccgatgtccccgctcgtcctgctggagctggtcggcccggcgatcggtctgcacgtctcggagaccctcaaccgggccttcccggaccgcttcacggtctccccgaacctcgcggccgtcgtcaaggcgggcaagcgcggcttctacgtgtacgactccgggaagccggagctggaccccgaggtcgccgcgctcctcaagcagggcgatgtcgtcctcaccgaggagcaggtccgcgaccgcgtcctggacgcggtggcccaggagatcggtctgatgctcgacgagggcgtcgtcgccgaggcccaggacatcgacctgtgcctgatcaccggcgcgggctggcccttccacctgggcggcatcacgccgtacctggaccgtgagggcgtcagcgagcgggcgaacggcaagcggttcctcgaggccggggtggcttcggttcccgcgtaacaccgcctcgtacacgaagagggcccccgccacggcgggggtcctctctgcttgttccgggcgacggggcataagggcccggtcgccggggccggtgtcaggccgcgtcgacccagccgtgccgccccgccccctcgggcgaccgggaccggccgggcatgagcgcgcccacgggtgccgggggtgccagctgcgccgcgctcgcgtcgcccatggcgtcgatggcctcgtagacccgctggcagttgcctcccccgcggtgcacgaagaagtcctcgacgcgcgcgcggtaggccggttcgacggtgaaaccgcggcggacgacctcgatgatctcgtcgacggcctggtcgacggtccggcagaccgggccgaagccgtcctcggagaggttgaagtagccgcgcttgtagtgccgcccgtagaagtcctcctcgtcgaaggggacgtagacgagcgggattcccatgtaggccacgtcgaagaacaccgaggagtagtcggtgaccatcagcgagcattccttcatggcctgctggacgttgcgcgtgtgcgggtcggcgacctcgatggacggcgaggagaacttgaagttgtgcaggtaaggccggatctcgtagtgcgggaagaactccaggtccacaccgaagtggtcgagcgcccggcccagccgggggtcggagagcagtgaccggtagaagcggtagtactcggactgggtgaagttggtcttcgccgggccggccgacttcttgtaggaggcggtgacgatccactgccgccaggtcggcatgagcaggatgcgcggcttgtccctcggttcacgctggagggcgtcgaagcgggggaagcccacgggcttggcccggtcgccgtacccggcttccagcgccatgaagtcgcgctcctgccggcccgccgtcaccagcaggtcgtagctggcgatgcgctggtcggcaccggtcgtcacatcgttgtaggtgacgccgtgctgaaggaacacccgctggtacttgaccagttcgccgaagcgatgcaggaagagcgccttcttgtagccctcggggacgagatacgactcggaatcgtacgacccgatgagcttggtcgcgtgcagcaggtacacgcggtgcttgaagctgccgagcgtgagcacccgcccgtacggcgcgaccttggcgcggtcggcggacgcgccgtcgatcacgtagtacgccttgcggcgcttgcggttctgccggatccacttgaagaaatggtacgagttgtcctgggccgtgtcggagcgctccccgatgagccagatctccttggagttcaggaacgggtaggtcagccagtaggcgaaccgcatgcgccagccggggttgcgcgtcttgaggatgcgcagctctcgcccggcccgccacagcgcgtgccggacccgggccgccgggccggaggcgacgagccgcaggtgcagggcgtcctgcgcggcgatcgtcagcatgtagcggtaggggccgacccggcccggccccttgagccggtgcagcgcgaggcgtgccttcatcacgacgttgcggtggcggctgccgtcggcgaggtgcacgcgcaggcgcaggtcgccgacgccgaagccgctgtccgcgagcacctcggcgggcagctccgcgtgccagcccgcgtacaggtcgcggccgttgcgggcgttccacaggtcgcgccggtacacctgggtgagcggcacggtgaccttgctgtggcgggtctggtagaccagctcgagacggttgtccatcgggccgctcaggtcgactccgggaaaggccatgcagccttcgacgaccagcacgtcgtcgcgggcgcggacgctctccaccacgacattggggtccttgacgcgggcggtggtgctcgggcggactcctccggcgaaggtccggtagaacccgtcgtcgtccagctccaaacggaggggcgccgcggccagggccggctcggggtcgcagaacagttcgaagttcccgctcttggcggcgtagtggtcgagctgctgggccgggctggtgacgaactcgacgatcacgtcgtcgggaatctgcgcgtagtgccggtggaggtcggcgaacatctcggccagctgcgtacggcccatgacgttgcgcgcgttgcacaggaagcccttgtacgtgcgggtggcgtaccggtggaacatgcggcggatctcggggcgttcctcggcgctgtagttcaggaggaagtggttgagccgcaggtggtccacgtagttggccggcttgctccacagggagtccatgatggaggagccgtcggggcgtccgcggtagtagtagacgggacggtcgacgaggctgagcgagttcgcgcggagcatcgcgggcagcgtgagccaggcgtcctcgaagtgcacgccctcgccgaaccgcaggcccaggcggcgcagcagcctggtactgaacagcttgttgcaggccgacccgctgaagatcatgtcgggggcgtcggcgaagtcgtggaagacccggtcgccgtcgccgaagtactccttccacgggccgtagggccggtccgggaagttgacgaggtcgcccatgacgacctcggagccgtcgcggcgggcggcttcgagcatcgcggcgagggcgtcctcgccgaggatgtcgtccgagtcgaggaaggtgacgtagggggcgctgacctggtcgaggcccgtgttacgcgcgttgcccaggccgccgttgcgctggtgcacgacggtgacgttggcgtagaagcgggcgaagtggtccagcatgcgcggcgtctcgtcggtggcgccgtcgtcgaccaggatgacctgggtggcggcgaagccgcgctgggccgcgatggaggcgaggcagtcgtccaggtacttggccacgttgtagcacgggacgaccaccgcgagctcgaagcggtgggtgagctgacggatcggcggatggatgcggtcgcgccaccacatccacggtgcgttcgggtcgctctgctcggcctcgaaggtgcgccggctcgcggtcgcggaacggaaggcgaggttgccgctgacggtgcggtatccctcgaactcctcgtcctcccgggtgaagtgcagaccgtcgaggtcgatgtcgcgcacgttcagcgcggagcgcgaccggctgcgattccactcgacgacgaccgagacgttccacacggtggcctcggagaggtcgtcgccgagcacgcggaccaggtccgcgctgccctcgaaggtcacgaagcgctcgtcgacggagaccttggggatcgggacgacgacgtcccgcttggtgtgccggttccgtacggccagggacagactgatggtgtcgtcggcggtgatccggccgaagcggttgacgagttcgccgtcgaaggtgagtttcgtgccctccacctgccagctgttgagctgggcgaagagcggtacctgggacacgggtgccgcggccaggcccagttcggtgacgtcgagcagacggcgggcgtccggcaggtggagatggtccccggaccagtagacgcggccgtcctcctccacgaggtaggaggagaagacgctcttgcgctgcgcgtagtccagggtggtcagggcggcttccgtctcctggtacatcaggaagtaggcccgcacccggtcgacggggccgcacagctcgaacgcctcgtcgctgacggagaacagataggcgctgaccgtcgccgcgaagccctgctcgaaggcggcatcgccctccgcgagggcccgcatgtacagccgcaggtcgtgcgagaggaacttggagtccttgcggaccttgagcgaccacagaccccgctcgaggaggaacgcgtccgtggcgcggtgcaccgcgatgcggtccctgatgctgcgcagctcgccggtgcggccggtgatcgacgcgccgtccgactcccacatccaccggtagacgggctcggtgatgaccgtgatgcccctggcgaggcagcccgcgacggtggagaagtacgtgtcctcgtagaagacgccctcggggaaccagactccggccgtgcgcaggaactcgacgttgtagagcttcgcggcggcgatggggtcggagagcaggagcgggaactcctccaggtcggacacggtgcggctcatcgcgtagacctcgggggcccagggctcggactcgccggtggtccggttgatccgcaccgccttgcccgcggtgatgtcgctgccggtctccagcgcgctcgcgacgagccgctcgcaggcgcggggcggcagttcgtcatcggcgtccaggaacatcacccagcgccctgcggcctgtgcgatgccccagttgcggggagccccgacgcctccgctgttctccttcctacggagcacccgcacacgcgggttgtttccggcgaagttggtgaccacttcgatggtgccgtcggtcgacgcgtcgtcgacgacgatcacctcgaccagctcgtaggtctggttcacggccgactggagcgccttgccgatggtggtcgccgcgttgtacgcggggatgaccaccgtcacccaggagttgtcgccgtcctgcacctgtctcatctcgagttctcccacgcccccggtgccccgcgccgctcgccggactgggctgtcccgtactgcgggagcggcccggcgccggcgtgctggcggggaacatgggggagtccgtcgtgctgctgcggaaggtcgtgcccgtggggggtgacgttcggctgcgggtagggccagaagccgggatcgtcctcggcctccggtgcgcggtaccgctcgtcggccagcagggcctcctgcgcggcacggcggtggcggccccggtgcagatgcggggcgatggtcccgacggtggccggggcgggactcagctcctccatgacgcgggtgaagtcgcgggtggagagccagaacttgtacatgatgacgagctcgaagagcatcacgagggccgcggagaccacggtggtccacaggatctgaccgatcagcggccccacgatgaagatgaacatctggaactcgatgccgctgatgaggtggggccggatccgggtgcgcagcatcgcccggcggacgcgcgtgtaccaggggaactggtcgcggaactgctcgtgcaggtccaccacgttcgccgcgccggcctcctcgcggagggtctcggccgccgcgcccgggttgtcccgcagcaggtcctccatgaagacgacctgctcgccctcggcgtcggccgggactccgcgcgcggcgcgctcctcctcctcacgcgctttggtgatcttctcgatcttcgtgcgcatcgacatgcgcatcttgtagatctggagcgcgtcgacgtagcgcagcatgtcgaggaagaccacgaccagcgcggcgaccagatagcgctcgtcgtcggtgggcaggaactgaccgcccatcagcgcgagggcgcagaacaggacgcggatgcggtcgaagacgtagtcgagccagcctccgaagacggtgccgttgcccttgagccgcgccagctttccgtcgatgcagtcgaggatgaagctcaggtggtagagcagcgcgccgatgagcagggactgggggtcgcccttgaggaagaagcccgccgcggccaggccgacgaacagcgcggcccaggtgacgcggttcggcgtgatgaaccggaaacgcgcgaggacgatcagcatccgcgtggcgacgggatcgacaaggaggaccgtccaccaggcatcccgcttcttgacggtcagcttctggacagcccgcagggacagcttggtcataactcctcaaccaggcgcaagacaggacaaaatgccctgcggctgcgccgtcgcgacccagggagctttcacaggtgaaccccgggtttcacaggggcttcacacgagagatccaaactttaacaacgcctcatcaaaaatgaacgtgtataggccacggcttgatcgcgacgttaatcacaggcgatcccgtacaaccatttcctatccggctataccggactctttccgtcctcttaccggtctctcacggaccgcccggggtcggcctcggaccgccggatcagcctcgggccgcccggggtcagcctcgggccggctgccagtcgccgaaggcgagggaacccgcctgctcacgccggtgcgcgacgagcagcccctgtccgggtgccctggtcgcgacggccagccgcccggtacggctcacggcggcggccggaatgccgtacgaccgctccgcgaggtcctgccaccacaccccggtgccgggcctgccctcgggataggcgccgaccgcgcaggcgccgccggaacccgaccgaatcagcagggagtacgcccagccgtccatctcgacgcccgacgccgcggccacgggcccggagccctccgcgtcaccgaggggacagggcgcctgggcgcccgggcgccaggcggaaggtgcgttggtccgcaggtcgcggaagtggatgctgcccggctccggcgccggggacatggtgccgggccgggccgcgaacggcggtgtgcggtcctccgtccaggcacccccctgcgccggataccagcggaccacggcctccgtgtcgcgggcccgggcgtagacctcgaccccgccgtgcggggtggtcaccgcgacgaggtcgtcggcgacccgggtgcccccgaggtgctgccacgcggtccagacgccgtccaccgactgacagcggtagctgatgctgtgtccgaagttccgtacgaagacgaagagattgccggcggagtcgaacgcggcggtcgggaaaccgacttcgcgccccttgcgccagtcgccggagttggggccgccgagcgagttccacggcgtcagcggctgcccggtgcggtactgcacggcgtgcacgacctcgacgtccacgccgccgtcgccgcgccgcgtcctgcgcagcgcgaacaggtgcgggaagccgtgcggatcgcgcaccacggtgagccccggcagcagaccggggccctccaccggttcggggccgcgccaggccgtgccgtccggcaggtcctggaaccagcgcaccaccccggcggcggtgggcaggaaggcggtcagccggccgtcgaagcccgccaccagccagttcaccggggcgggatgccgcaggcaggacgcggcgcccaggcgtacgtccgccttcgcccggtggcagtcgacgtagaggggctctccggtctccgactggagagcgcgtgccgcggcgagcgcgtccgccgcgatgtcggcgtgcccggccggctcgtcgtacaccggcgttccgcccgtctcgtcgaacgagacatgaacggggtccgggtccagggtgtgcagccgctcggggttgatctcccgcagctcgtcgagcagcgccgcgacagagtcgccgccctcgccccccaggatccggggagcgcccaggacgcggcagccgcgctcggcggcctgcgcgagagcccggtcgagcgccgcccggccctccttcgcccccgcccgcaggcagacgacggcgatctcggcgccgggcgcttcgagcgtgacgagtggcaccgcggccgcgggttccgtgacgaccacggccaccacgtgcggacgaattcccggcgcctgggcgacggcgccgcccgctctgcgctcggacctgcgtgtcataccctcacgtccctctccccgggtgccgcggcgacccgggtcatatccggctccaggtgctgagtgtcagccccggtccgtcctcctggcgggccagggtcagcgagccgtcggcggcgacggccagcaccaccacccgcccccgcccgtcgagcgcgaggacaggatcccccaggcaggccgtgccggtgtccgtccaccacactccgttgccctcgtcctccgcgacgcagacgccgagcatgatgcgcccctcggcgccccggtgggcgagcacggtgcaggggtagccgtcgagggtggtgctcaccaccgcgtgccgtccgtcgcccgggtccccgccgagcggaacgggccactcccccgcgcggacggcgaccatgccgccgcgcacatcggtcaggaagtacgtgacccggccgggagaggtctccgctccggtcacggatccgggcagcgggatcacgccgaagtcgtgcccgcgccgcagtaccgcccccggctccggctgatgccaggtcagagcgccggtgcgggccggggcgagaagttccacgtgtccggtcgacgtcgagacggccgccggagtgtccaccgcggcggtcacctggagatcgagccagggctcccagcgcccctgggtgtcctcccgccggacggcgacccggccctccgccgtgggcacgaagacgtacagggtgcccgcggtgttgacggcggcggtcgggcctcccatgagcgcggtgcgttcacgcttggcgtgcgggttgccgatcgaccgccactcgctcaaggggcggcccgcctggtactggatcgcgtagaccaggtccacggtgagcgaaccgtccttcgcgggacgcacccggcggcccaggagatgcgcgtaccggttacggccctgggcgaccgtgagatgcgacaggcccttcgccggcaggacgtccggtccgagccagtcggggccgccgggccggcgctcggtccagcggagtaccgcctggtccaccagcgcgtacgcgaggagccggccgtcgtgtccggggaggagccacggccccgaccgcacggccgccggccggtcggcgaggtctagtgcttcctcgcccaccggctgctgccgttgcccgttcgcacgcgcggaggtggcccgcatggtcttcgtcgtccttcccaaggcgtcggcccccggtcctttcgggggcccgcacgccggatcgtagagagacggcccggccgtcagcgccgcgcctgcggatgccgcgcgcaccagcccgcccacgccgacgcgaccatcgcgcgcgcgtcgtaccgggccgaccagccgagttccgcctggatgcgatcggccgcggcgaccacccgggccgggtcaccgggccggcgggcggccgacaccggtgccgcgtcggcaccgtaaccggtcacctcgccgatcagctcgatcatctcgcgcacggagacaccctcaccgcggccgatgttgaccgtcagatcactgccgggctcccggccggtcagcgcacgcgccgcggccagatgggcggaggcgatgtcctcgacgtggatgaagtcccgtacgcaggtgccgtcctcggtgtcgtagtcgtcaccgaagatcaccggcgccgtgccctgggtgagcttctcgaacaccatcgggatcaggttgaacaccccggtgtccgcgaggcgttcgtcggcggcccccgcgacattgaagtagcgcagggaggcggtggtcatgccgtgcgcgcggcccgcggcacgcaccagccactcgcccgccagcttcgtctcgccgtaggggttgatgggggcacagggtgtgtcctccgtcaccaccttcacatcgggcatgccgtacacggccgccgaggaggagaagaggaagttccgcacaccggtttcggcggccgcgtccagcagggtctccagcccgtggacgttctcgcggtagtagtacagcgggcgttcgaccgactccgcgacctgcttcttcgccgcgaggtgaacgacacccgtgatgtgcaggtcggcgagggtgcgccggagcagcccgccgtccagcgtggagcccttcacgaagggcactccctcaggggtccggcccgggtctccggtcgacagatcgtcgtacacggcgacccgctcgcccgcctccagcatcgtgcggacgacatgcgccccgatgaaccctgccccgcctgtgatcaaccaagtcatggccgcatactatttctttcggtcttgttcacgaatacatcacgatccaaccatgaacagttgaatacctgtctatagtgcaggctcagtcaggcagatcacggaccggccactccccccacccgggtccccacgccgttcagcaccgccctcaggggcacgacaagcgaggactcaggcaggatgagccatgtctcgacgccccagcgccgaagcaccggtgagacaccccgcggacgcggcggtcgcggacgcaagcggcccggaggccgccgaacaggccggaagatcctgctcgccctgctgatcctcgtcctcgcggcggccggcaccggctactggctctacagcgacctcaacaacaacatcgagggcgtcgacatcgacaaggcgctcggggacgaccggcccgagaagctggccacctccggccagaacatcctggtcctcggctccgactcgcgtgccggcaagaacgcctcgctgaacacgggcaaggtctccggggcgcgttccgacaccgctctggtgatgcacatacccgagggccgcaagaaggccgtcgccgtcagcatcccccgcgacaccctcgtgacccgtcccgagtgcgccaagtcggacggctccacgctcgcctcggcgaagcgcgtgatgttcaactcggtctactcgcaggccggtccggcgtgtgtggtcaagaccgtggagcagatgtccggggtgcggatggaccacttcgtggagatcgacttcgccgggttcaaggggctcgtggacgccataggcggtgtgaccgtcaccgtcgaccaggacatccacgacacgtcgagcggcctggaccttaccgccggcacccacaagctcaacggcacccagtcccttcagttcgtccgcacccggcacggcatcggggacggcagcgacctcggacgcataggcctccagcaggagttcatgctcgccctgctctccgagatcaagcagcaggatctgctgggcagccccacgaaggcgtacaagatcgccaacaacctcacggagtcgctcaccacggactccggtctcgcctccctcaccaagctggccgagttcggccgcagcatgaacggcgtcgacccgtccaccatggagacgatcatgcttccggtggcgtacgacaaggccgacccgaaccgggtggtggccgccgagccgcaggcaacgacgctctggaaggcgctccgaacggacgcgaccatcccggagtcggcgaagaagtcacccgcgaccggcgggacgtcgtccgcttcgtgacggcccgacggccgggccccgcgccggccgcggggcaccagggcaattcgcccgtttccgtcccagcgcccacactggactcggcaaccccgcccagggcccaggaggaaacgcgtgacgactcttgtgatcatcgacgccgccaacgtcatcggctccgtccccgacggctggtggcgcgaccgccggggcgcggcggaacggctgcgggaccggctcgcgcgggacggggtgccgggagccgaggggccggtggagatcgtgctcgtggtcgagggggcggcacgcggtgtggagtccgtgcccggtgtacgggtcgagtcggctcccggcagcggggacgaccggatcaccgagctggccgccgaggcggccgggcgcgaccgcctcgtggtcaccgccgaccgtgaactgcggcgcagggtacgcgagtcgggggccgaggtggccgggccccgggcggtgctcggtccgtcctgatcaccggtacgacgagatcgccgaggccgtcgacgacgtcgccccgcgtaccgcgccacgtcagtcccgtccggacgcgggcgcgtacagcaccgccccctccacccgccccacctcctcgtacccggccgccaggatccgccgcagcgacggcacccgctccggccggtacggcttgtcccgggagtcgtcgacgatcagggccggcgggtgcgcggccagctccgcgcggaaggccggccaggcgccctcgaccgcgtacctctccccgacctggggcccgtcgcggcctccgctgtagttggtgaggaggcccgccgtgaggtagcggctggcgggggcacggtcggcgagccagtacgtctccgggtgtatgccccagaccaggaccgggtcgccgggtgccgtgcggcggaccaccgcgtccgcgaggcgctcggcgtgggcgaggtcggagcggggcgccagcagaccccacgtcaggaacagcgtgcagcagcacgcggaggtgaacaccgcggtcaccatgcggtcgcgcggcagggcctgcaacgcggccgtcgccaacagcgcgacgggcgggatgagttgcaggaagtagtggccgaagaagtggaagcccagcagcaccgccaccgccgacgaggccggccacagccacagctccgccgggcccgtacgggcccggcgcaggacgcggaccaccgggggaatcagcccggcacaggccaccgcgaggatcgcggtgttggtcagtccccgggtcagtacgtggagttcggagccggtgaaggcggcgtaggcgcccgatcccgtgaccgtccagaacacgaagcccgccggatcggtgagcacagccgcgcccagcaccggcacgatcgccccggctcccagccgtaccaggcccgtccgtgacacaccgccgcggcacagcagccacaccaccggcaccagcaccgcgccgcccgtctgcttcaccaggaaggcgcaggcgacggccgcccccgccgcgccccatcggcgccggtccgcgcaccacatcgcggcggccgtgcacggcagcatgaacacctcgaaggtcgcggcctgcgcgtcctgggggttgagccccacggaggccagcagatacaggacgcccgccgtacggcccgccccgtcgccccagcggcgcctcgccagcgacgcgagcagcaccgcggtcagcagctgtgccagcaccgcgagcacccgcacggaggtgagcgacccggagccgcacaccgcgaacgcgccctggtacagccacggcagcagcggcggcttgcggtccacgaccgtctcgtacagctctccgccgcccgccagcatccgggcctgtacggcgagatagccctcgtcggggctccagagcggccgtacgaacgaggggacgcgcgtcagacaggccagcaccgtcagcgggggcagcagccggctccagtacccgcgctccctcctcggtgcgactacggaacgtggtgcgtcaaggggctcgacgagcatacggagcacgctatccggccccgcggtctccaccgaagcgggacatacggggccggggcgtcgaagacagggattactcggtgtcgccgaccgggactactcgatgtcgccgcccgacggcgtcggcgtccgaccggccgcggccgcctgctcccgtccgaggcggctgtgcgagcgcccgtacaggaagtacacgacgaagccgatcaccatccagaccgcgaagcggatccaggtctcggcgggcaggttcagcatcagccacagcgaggcgaggaccgacaggatcggcaccaacggcacgagcggggtgcggaaggcgcggtgcaggtcggggcgggtgtgacggaggatgatgacgccgatggcgaccaccacgaaggcgaagagcgtgccgatgttgaccagttcggccagttcgctgaggctggtgaagcccgcgacgatcgcgatgatcacgccgagcaggatggtcggccggtgcggggtgcggaacctcgggtggacgcgggagaagaaccgcggcagcagtccgtcgcggctcatcgcgaagaagacacgggtctggccgagcagcaggatcatgcagaccgtcgtcagaccgacggccgcgccgaagctgatgacgcccgcgtaccaggggtgtccggtggccttgaaggcgtcggcgagcggggcgtcgatggagagccgggtgtacttctgcatgcccgtgacgacgatcgacacggccacgtacagcgtggtgcagatgaggagcgagcccaggatgccgcgcggcatgtcccgctgcgggttcttggtctcctcggccgccgtcgccaccacgtcgaaaccgatgaaggcgaagaagacgacggaggcggcggtgaagatgcccagcactccgaagttggtgggtgcccagccgaacatcagctggaccagcggggacttgactccgctgcccgccgccacgtgctcggccttggggacgaacggcttgtagttgtcgccgctgatgaagaaggcacccgcgatgatcacgatcatgacgacggtgaccttgatcgcgacgaccaccgtggtgacccgggcggacagcttcacgccgatgaccaggatgacggtgaggacgagcaccagcgcggcggcgaggatgtcgaagccgaacccggtggccccctcgcgcccgctgaggtagtcgggcagatgccagcccgcgttgtccaggagcgagcgcacgtaccccgaccagccgacggccaccaccgccgtgccgagcgcgaactccagcaccaggtcccagccgatgatccaggcgggcagttcgccgagcgaggcgtacgagaaggtgtacgcggaccccgccaccgggaccgtggacgcgaactccgcgtagcagagcgccgcgagtccgcaggcgatgcccgcggcgacgaacgccagcgagacggcaggcccggcgttctccttggcgaccttgccggtgaggacgaagatgccggtaccgatgatgacaccgacgccgaagacggtcaggtccaacgcggacagggatttcttgagcgcgtgctcaggttcctcggtgtcctggatcgactgttcgaccttcttcgtcctgaagagggtgctgctcacgggcgtacctcccacgctgcgtcgtccccgacatgatcgagagggggcgtggtccgtatgccccggcacggggggtgtcacgcgaatgggccggttccaccaccgtaaagggtgctgaaaccggcccacctggatgcgtcagtcgcgcgcgggctccaccgagtcgatctccgccgtcgggcgctcgaagcggccgtcgagcttggagacgagcccggtgacctggcgggcgatgtccggcgcggtcaggccgatctccgccatgacctcgccccgggaggcgtggtcgaggaagcgcggcgggatgccgaagtcgcgcagcggtacgtccacgcccgcgtcgcgcagggcctgcgcgatcgccgagccgacgccgccgacgcgggagttgtcctcgacggtgacgaccacgcggtgccgctcggcgagcggggccatggcctcgtcgacgggcttgacccagcgcgggtcgacgacggtcgcggagatgccctgcttgtcgaggaggccggcgatctccaggcacatgggcgcgagggcgccgacggagacgaggagcacgtccggggcgtcggtgccgggctcgcgcaggacgtccatgccgccgatccggcccacggcggggacggccgggccgaccgcgcccttggagaagcggaccacggtcggcgcgtcgtcgacgtcgacggcctcgcgcagctgggcgcggacctggtcggcgtcacgcggcgcggccaggcgcaggcccggcacgacctggaggatggacatgtcccacatgccgttgtgcgaggcgccgtcggtgccggtgacgcccgcgcggtccaggacgaaggtgacaccgcacttgtgcagggccacgtccatcaggacctggtcgaaggcgcggttgaggaaggtggcgtagacggcgaagacggggtgcagtccgccggtggccaggccggccgcggagacggcggcgtgctgctcggcgatgccgacgtcgtacacccgcttcgggaagaccttggcgaacttgtcgaggccgaccggctggagcatcgcggccgtgatggcgacgatgtccttgcgctcctggccgagcttgaccatctcctcgccgaacacggaggtccagtcggcgccggaggaggcgatcggcaggcccgtgtcggggtggatcttgccgacggcgtggaagcggtcggcctcgtcctggagggcgggctggtagccgcggcccttctcggtgaggcagtgcacgatgaccgggccgccgaagcgcttggcgcgggcgagcgcggactccagggcctcgatgtcgtggccgtcgatcggcccgacgtacttgaggccgaggtcctcgaacatgccctgcggggcgatgaagtccttgaggcccttcttggcgccgtgcagggtctcgtagagcggcctgccgacgaccggcgtgcgctccaggaggtccttgccgcgggccaggaagcgctcgtagccgtccgtggtgcgcagggtggccaggtggttggcgaggccgccgatcgtgggggcgtacgagcgctcgttgtcgttcacgacgatgacgagggggcggtccttggcggccgcgatgttgttcagcgcctcccaggccatgccgccggtgagggcgccgtcgccgatgaccgcgaccacgtggtcgtcgcgttcgagcacctggttggccttggcgaggccgtcggcccagccgaggaccgtggaggcgtgcgagttctcgatgacgtcgtgctcggactcggcctgcgaggggtagccggacaggccgcccttcatcttcaacttggagaagtcctgacggccggtgagcagcttgtggacgtaggactggtgcccggtgtcgaagagcacccggtccttgggcgagtcgaagacgcggtgcagggcgatggtgagctcgaccacgccgaggttggggccgaggtggccgccggtcttggagacggcgtcgacgaggaaggtccggatctcctctgccagctggtccagctgctccaggctgagccggtccagatcgcgcggtcccctgatgcgggtcagcagcggcacccgtgcctccttgcagtagagctgttcgagctgttgccgggtccgtcgagtctaatgttccgttgtgccgggtggcgtccggccccggccacgtacaccatacgatcggccggaatcgttcggacacggctgcgcccggcaccgccattggtgccgggcacaggtccgggagggggccccgcaggacgcgcggggccccggtgttcggcggagcgcttacgcgcggcccgccgacttctgggtcttgcgggtgaccgcgtcgatgacgacggtcgcgaggagtacaccaccggtgatcatgtactggaccggcgaggcgatgccctgaagggccaggccgtactggatcgagacgatgaccagcacaccgagcagcgcgttccaggtgcggccgcggccgccgaacaggctggtaccgccgatgacggccgccgcgatggcgttcatcaggaggtcaccggcaccggcaccctggttcgccgaggcgatcttggaggcgatgaacagaccgccgatggcggcgaaggtgccggagatcgcgtagaccgagatacggaccgcggcgacgttgataccggcacggcgggacgcctcgatgctgccgccgagcgcgaagatcttgcggccgtacgcggtgcggcgcagcacgaagtccgtgatcaccaggaccgccaggaacaggacgacggccagcggcaggcccttgtactggttgaagacggcggcggcggcgaaggccaccacggcgaggagcaccgtacggacgatgatctcgctcagcggacgggacggcacccccgcggcctcacggcggcggttgtcgaagaacgtggtgaggaagaagaccgccacggcgaacacggcgagaccgtaggccgccgccacgtcgctgaagtagtaaccgctcagcttggccaccaggccggagctgtccaggttgatcgtgccgttgctgccgaggatctggagcatgaagccgttccagaacagcagacccgccagggtgacggcgaaggccggcacaccgatgcgcgcgaagacgaagccgtggatggcgcccgcgaccgtacccgtgaggatggcgagaatcagcgccagccactcgggcatgccgtgggtgacgttgaggaccgcgaaggcggcgcccgcgacaccgctgacggaaccgacggagaggtcgatctcgccgagcagcagcacgaagacgatgccgacggcgatcatgccggtaccgaccatcgccacggagatgtcggagaggttgcccgcggtgaggaagttcgagttcaggctcgcgaagatcgcccagatgatgatcaagccgacgacgaccgggagggagcccaggtcaccggcgcggatcttccgcttgaactcggagatgtagccggcgaagcctcgttcgcgcacgagcagccgggggtcgacggcgacgtccgatcccgcggccgcctccgggttctcgacggcggcctggtccgcggtcgcggaggtcttttcgatgctcacttctgagcctccccgttgcgggccgcacgacgggtcacggcgttgtccgtggcacccgtgatggcggagatgatctcttcctgcgaggtcgacttgacctcgaagacgccgttgttgcgccccaggcgcagaacggcgaccttgtcggccacggccttcacgtcagccatgttgtggctgatgaggatgaccgcgtgaccgcgctcgcgcagccgctccaccaggtcgaggacctgtgcggtctgctcgacaccgagggccgcggtgggctcgtcgaggatgaccagcttgggctcgccgagcatggagcgggcgatggccacggtctggcgctgaccgccggagagcgaggcgatcgggatgcgcacgctggggatgcggatcgacagcgtggtgagcagctcacgggagcggcgctccatctcgacctcgtccaggatgccgcgcttgcgcagctcccggcccaggtagaggttgccgaccacgtcgatgttgtcgcacagcgcgaggtcctggtagaccgtcgcgatgcccaggttctgggcgtcgtgcggcttgttgatctgtacggccttgccgtcccactcgatgacgccctcatcgatgggatgcacgccggcgatcgtcttgaccagcgtggactttccggcgccgttgtcgcccaccagggcgaccacttcaccggcgtggatctcaagctctacgtcggtgagcgcctggacggcaccgaaccgcttggagaccccgcgcaacgccagcacgggcgtagcggacacgtgaaccatctccttcgccgcctgacccggcgggaggttgtgcagaagtttggagggggagttccgtccggcgccccgccctagctttgcggggctgatggatgcggggcgccggaggggcttggagcaggcacgtcccgaacgggaatccgggggcgaattcccgtacgcggtaagggacgtgcagctgcttactcgagaccgatgctgtcgcaggccttcttgtacttcgccgtgcagatgtcggcgaccgtgtagaagccttccttgatgaccgtgtccttgatgttgtccttggtcagcgagatgaccgggacgatgaccgacgggacctgcttggtggtcgggctgtcgaccttgctcgtggcgatggagtcgagcttctcgcccttgccgagcgcgacggccatcttggcgaccacggcggcctcctgcgggtaggacttgtacacgctcatgtactggtcacccgtgacgatgcgctgcacaccggcgagctcggcgtcctggccggtgaccgggacggagatgcccgcggacttgagcgcctggatgatgccgcctgccatgccgtcgttggcggagtagacgccgacgatgttcttcttgccgagggcggagatggcgccctccatgttggcgttggcgttctccggcttccactccttggtgtcgtacgacttcgcgatgtcgaccttgcccttgagctcggcaagcgcgcccttcttgaagaaggcggcgttcgggtcggtgatcgcgccgttcatcatgacgatcttggcggagggcttggccttggagcccagcgccttcaggagggccttgccctgggcgtggccgacctcttcgttgtcgaaggaggtgtaggcgtcgatcgggccctcggccaggcggtcgtacgcgacgaccgggatgccggcgtccttggccttcttgaccgagttggcgatcgccttggcgtccaccgcgtccacgatcagcacgtccaccttgttggtgaccatcgtgtcgacctgctggctctgcgtggtggcgtcctgcttggcgttggcgtagacgaccttgcccttgccattggtcaggtccgcgacctgcttcttgatgatcgggtagtcgaacttctcgtaacgcgcggtctggttctccggaaggagcaggccgaccgtgatcgcgtcgcccttcttcgagctcgaggtgtcgctgtcacccttggattccttggcactgccacaggcggccagcgaaacggccatcgcaccagcggcaacagcaacggcggcacgacgcatacgcgtgttcacttcagaaacctccctgacgaggccgcgacgttgcggccgaggtggctggaagtcaactcggccacacgtgcgacgtcaagaagtaaatacttaacgagatggcaacggtgccatgcgttctctaagtgaaggcaggggtggccgcggaaagcgtgccatccaaaagggtcgaatcgcccatctcgctcaacgcgagagcgagcgctccgagcacctcggcgcggcccccaagtgcccctggaagcaccgagagttgacgtgcggcgctggggatcgcataccggctgacagactccctgatgggccccaggaccagctccccggcctcggcgagatcgccgccgaggaccaccctgctggggttgagcagattgcagagattggcgactccgctgccgatgtgacggccgacgtcggcgatcacccgccggcatcccggatcgccgtcccgcgccagcctgaccacgccttccatggtcagatcggtgccgtgactggactggaggagcggcagcacatagcgcgccgccgtgaaggtctcgaggcagccgcggttgccgcagcggcagacggggcctgattcatcgagagtgatatggccgatttcgcccgctgtgccgccggggccgcggtagatcttgccgctgatcaccagcccggccccgacaccgctcgccaccttgatgtacgccaggtccttgaccccccggccactgccccagaccagctcgcccagggcgcccaggttggcgtcgttgtccacgtacacgggcacgccgagccgcccccgcagctcctcggcgggcttcgcgccggtccagcccggcaggatggaggtggagccgagggtgcccgactcgacatcgatcgggcccggcacaccgaggcccacgcccgcgatcttggaccggtcgaccccggttgccgcgatcaggcggctgaccagctcttccgcccggtcgaagccctgtgcggcggaggcgtccacatcgagcggctcggactcctcggcgagcacctggtgggccaggtttccgaccgcgacgcgtagatgcgtatgcccgaagtcgacgccgatgacaatgccggcgtcgccgctgagggagacgctgcgggccctgcggccacccgccgacgtgggcgtgacctcgacggtcccgccgtccttgagctcccgcacgatattggagaccgtcgccgcggacaggcccgtcgtcctcgcgatctccgcctgcgtgagcgacccggcaaggcgcaccgcacgtacgacgcgctccagattggctcgatgcagggacgactgcgaccccggagtctccacgacgacctcccgcgtacgaggccgccacgatgaggccccgcctatgtccaactagtgaactctaagctgagccgtttgggttacctcccgtcaagaggttgagctgcatccgacgcggatgagcgcgcgtgagggccgcgccccgatggaaaaccggctgcgacagggtcgataccgcccgtgtctcacgtcacagcagcaaaatccggaccacgtgcgaggtgtcaccctttcggccgtgaacgatcgagcaggtgctccggtcgttcacaccttgtcgcgctcccggccgcccctacggcgcagacgagcgcccgcccggtcgccttccggcccccgccgcacgctcccctacttcaatgcgcccgccgtcagtccctgcacgacctgcctctggaagatgatgtacgccgccagcacggggagcatggccatcaccagacccgcgaacaggcccgaccagtcgcccttgtacccctggctggtcgccagctctacgaggccctgggaaagcaccttcttgtccgggtcggtgttcagcaccgtcgggagcatgtactggttccactgccccaggaaattgaagatgcccacgctgatcaggcccggcttggccatcggcagcatgatctggaagaacgtccgggtgtgcgacgcgccgtccacgaacgccgcctcggcgatcgacgtcggcaacgtcctgaagaaagaggtcaggaagaagaccgtgaacggcagcgagtacgcgatgtagacgaggatcaggcccggcagcgtgttcagcagccgcatgttgttcagtacgtagaacaacggcaccagggcgagcatgaccgggaagctcattcctccgacgaagaggaagtagatgaagcggttgcccggaaagtcgaaccgggcgagaacgtaggccgccatcgagccgagcacgagcgtgccgaccagcgagaagcccaccactatgagcgtgttgccgaagtagtcgctcatgtgagcctgtgaccaggcgcgcgaccagttctcgaaatgcagcttgtccggcagcgaccagggcgagctgaaaatggagtcgtcatccttgaaggacgtcatcaccgcccacaggagcggcagaacgaccatgatcgcccagaggatgaggacaccgtgcgagaagacgttcaggacgccgccctcgctgctcttctccttcttccgcgcggccgctgtcttcgtcactcgcggacggtcctcgatccggtccaccggaggcggggtgtcagtggtcttcatcagtactccagccgctcgcgccggcccagcctcatcacgatcgccgcgaacagcagcgtgacgacgaggagggcgacaccgatcgttgtcgcgtaggcggcgttcgcgtcgcggaacgccgattggtacacgtacagcggaaggaccgtggtcgagtagtcgggaccaccgggacctaccgtcatgatctgcacggcggcgaatgcctcggcgccgagagacagaatgcccatgtagacccatccggactgcacggtgtcccagagcagtggaagagtgattttgaagaacgtggtgaaccggctcgcgccgtcgaggagagcggcctcgtagaagtccttcggaatcgacgccattcccgcggagaacagcaccacgaagaacccgaccgtgctccacaggagcaccgccatcacacaccagagggcgagattcgggtcgcccagccagtccggctggacacttccgagaccgatggcctgcaaagtcccgttgatcacaccgtcgttggggttgtacgcgaactggaagagcagggcgacgatcgcgatcgacagcacctgcgggaagaagtaggcgatcttgtagaaacccgagccgcgcactccggtgatggcggcgcccttacggcgccgcccaccgacattgagcatgaaggcgaagaacagcgcgaggctcagcgtcaccagcggcagcagcaaggcgaaaaccagactgtgccgcaacgacttccagaagatgtcgtcgtcgaacattctggtgtagttcgcgaagccgaccatcttgaagtcggggctcagaccggtccagtccgtgaacgagtagtagatcgcctggatgaacggccagatcacgaagatcgcgtacagcgccaagggggccaccaagaaccccacaatgaaacggtacttgccgtgttgcatggttaccgaccccgatcgtttcgcgggtgccgccgctggtgacgcgtccgcacgtgctgctactggtgcttgtagtgcttgatggactggtccttggcagccgcgtccgcgtagccctggatcttcttgatggcctcggccggggtgagccgccctgccatcatctcgccgagaccggagacaccgatctgctccttctggagcttcacgtaccagtcctggaggcgcgggttgaccacgttgtcgccggccttgtccagggccgcgacaccggacttgaggcccggggtcagctcgatgccgtccgtaccgccgttgaacgcggtgagcgacttcacctgactggtgaagttcttcgacgacgcctcgctgagcatgatgcggagctgctccatgccgccggcggggttgttcgccttggccggaacgatgaacggttcgccaccggaggcccagatggtcccgaacggcatcttgtcggagctgtcgaggccggacggaccgctgaccgccaggttgaagtccgccgggatgaccttcgcggactcgttctccacccaggagccgttcgggatgaacagcgccttgcccttggcccaggcggtctgcgactggatgtggtcgatgcccggggtgcccttgaggatgtagcccttcttgtagagctcgtagtacgcctcgaaggcggacttgacggccgggtccttccaggcgttcggctccaggttgtcgatcttgtcgagaacctcgcggccgccgatcttggcgatgaaggggtagagcgagaacggcaggtagtacgggtacttgcccgcgtacgtccagccggcgatgcccttcttcttcgccttcgcgcagagcgcgagcatggcgtcccagtcctcggggtacgtcgagtcgagcttctcgagggcggtctgcgagtaccagacgccgtagaccgtgtaggcgtagtacatgatccagacggggtcgccgtcgaactggcccatctccacgatcccggggcgcagcgtgtcgcggaccttcttcgccgggtcgtcgatcgacggcgcgtcgaggagcggcgtgaggtcggtcagctgcttcttgccgacgagcacacccatgtccatctgctgggcgcccgagttgtcgatcaggtccggcggagtgccgccgttgaacttgggctgaagctcggactggatcttctgggtcttgtggaaatcgatcgtgaccttgggatacgccttcttgtactcggcgttcgcgtcggtcgcgtacttcgtaccgaaaccgccgtcgaagatgacgaccgacagcgcggcggtctcgttgacgcccagcgggttcttcttcgtcttcttgccggtcttggccttgtcctcggaaccgctgtcgctgctcgcacaagcggacaagaagctcatcgtaggtacggagatcagaccgagcgcggcggaccgcttgatcaggtcgcggcggccgatgcctccggtgttgcggttctcggcggaagtggatcccatgctcaagtcctcgccttctccaggactcaggcggtgaaccggatcctccccggcaccgcggtgatggtgaagctggggtcgtgcatgagggattcagtgggacggcacggcagtcacgcgtgctccgaacggtccgccgcctcccgattccccccgggtcctgcctgtccacagccgtcgaacgactaggcggacgccgacaggtatagtccacttcttgccagcggagcaacatcgaacgcacggtgggccttgggtcttttccgagttgagacctcgcggaaatatgagccgactgtgtgttgcccgagcaaagatcgacactgctcgggcccctcggaatgcgcgcgatacgtggcgcttcgcgcgctatgggacccggatgccacatccaacacccttgacagcaccggccacttgaacccctactggtgcttgcccgcgaagttgacaacgttgtccatttcattccgaggcgcagggagggtgctcgcgcatgcagcacggagctcggcacaggtggggtttgacatccgggtacagacccggttccgggcgcaggcccggtccttcggcggtcgttgcggtggccgccttcgctctggtggtggcctcgcagggcgcggccgtggcccggcccgcccaagcggcggcggccgaccgggaattcgcttcctcgttcgagtccggtgagccggccccggactggctcagcaccgtcgacacggcggcggacggttcgaagcgggcgtcgggggtggacggcggctacagcaccggcattccgggcaatgtgaccgaccacgtcacggatgtccgggccggcgccgagaacaccggagcgggcgaggtgaaggagaacctcgtcgacggcgaatcgagcaccaagtggctgacgttcacgcccacgggctgggcggagttcgacctcgacgccccggtcaagctggtgacgtacgcgctgacgtcggccaatgacgccgacgagcgcgaccccgccgactggaccctccagggctcgacggacggcaaggactggaagaccctggacacccgcaccggcgagtcgttcgccgagcggttccagacgaagtcgtacgaccttgcgagcccggccgagtaccagcacttccggctcgacatcaccaagaaccacggcgcggacctcctgcagctcgccgacgtccagttctcgacgggcggcacctccgacccggcgcccaaggacatgctctcgctggtcgaccgcggcccgagcggctcccccaccgccaaggcgggcgccggcttcaccggcaagcgggcgctgcggtacgcgggaacccacaaggccgacgcgcgggcctactcgtacaacaaggtcttcgacgtcaatgtgggcgtcgggcgggacaccgagctctcgtaccgcatcttcccttcgatggcggacaaggaccgggactacgacgccacgaacgtctccgtcgacctggtcttcacggacggcacctatctgagcgacctgaaggcgacggaccagcacggcttcgcgctgaccccgcaggggcagggcgctgccaagatcctgtacgtcaaccagtggaacaacgtcgtctcgcggatcgggtcggtcgcggcgggcaggacggtggaccggatcctggtggcgtacgactcgccgaagggacccgcgaagttccgcggctggctggacgacatagcgctgaaggccgcgccgcccgagaagccgaaggcgcatctgtccgactacgcgctgacgacccgcggcacgaactccagcagcggcttctcgcgtggcaacaacttcccggcgacggccgtgccgcacggcttcaacttctggacgccggtgaccaacgcgggctcgctcagctggctgtacgactacgcgcggtccaacaacgcggacaacctgccgaccatccaggcgttcagcgcgagccatgagcccagtccctggatgggcgaccggcagacgttccaggtgatgccgtcggccgcgtccggcaccccggacaccgggcgcaccgcgcgggcgctcgccttccggcacgagaacgagacggcccgtccgtactactacggggtgacgttcgagaacggcctcaaggcggagatggcgccgacggatcacgcggcggcgctgcgcttcacctatcccggtgacgacgcgagcgtgctcttcgacaacgtgacggaccaggcggggctgacgctcgacaaggagcacgggatcgtcaccggctactccgacgtgaagtcggggctgtcgaccggggcgacgcggctgttcgtgtacggggtgttcgacgctccggtcaaggagggggcgtcctccggggtcaagggctatctgcgcttcgcgccgggcgccgaccacaccgtcacgctgcggctcgccacctcgctgatcagcgtcgaccaggccaaggacaacctcggccaggagatcccggacggcacctcgttcaccacggtcaagaaccgggcccagcagcagtgggacaagctgctcggcaaggtggaggtcgagggtgccacgcccgatcagctgacgaccctctactccagcatgtaccggctgtacctgtaccccaactccggcttcgagaagatcggttcgaagtaccggtacgcgtctccgttccagccgatgccgagcccggacaccccgacgcacaccggggcgaagatcgtcgacggcaaggtgtacgtcaacaacggcttctgggacacctatcggacgacctggccggcctactcgttcctgacgcccggtcaggcgggcgagatggtggacgggttcgtgcagcagtacaaggacggcggctggacctcgcggtggtcgtcgccggggtacgcggacctgatgacgggcacgtcgtcggacgtggcgttcgcggacgcgtatgtgaagggcgtcgacttcgacgcgaaggcggcatacgacgcggcggtgaagaacgcgacggtcgtaccgccgtcctccggggtgggccgtaagggcatggccacctcgcccttcctcggctacacgagcacggacacgtccgagggcctgtcgtgggcgatggagggctacaacaacgactacggcatcgcacggatgggccaggcgctctacaagaagaccggcaagaagcggtacaaggaggaggccgcgtacttcctcaaccgggcgcaggactacgtgaagctcttcgacgggaaggccgggttcttccagggccgcgacgggaagggcgactggcgggtcgactcggccacctacgacccgcgcgtgtggggttacgactacaccgagacgaacggctgggggtacgccttcaccgcaccgcaggactcgcggggtctggcgaacctgtacggcggccgtggagcgctggccaagaagctcgacacgtacttcgcgacgccggagacggcctcgccggacttcgtcggctcgtacggcggcgtcatccacgagatgacggaggcacgggacgtccggatgggcatgtacgggcactccaaccaggtcgcgcaccacgtgaactacatgtacgacgcggcgggccggccctggaagacgcaggccaacgtccgtgaggtgctgtcccgcctctacaccggcagcgagatcgggcagggataccacggcgacgaggacaacggcgagcagtcggcctggtacctgttctccgcgctcggcttctatccgctggtgatgggcagcggcgagtacgccatcggctcgccgctgttcaccaaggcgacggtgcacctggagaacggccgggacctggtcgtcaaggcgccgaagaacagcgcgaagaacgtgtacgtgcaggggctgaaggtcaacggcaagaagtggacgtcgacctcgctcccccactcgctgatcgcgaagggcggggtactggcgttcgacatgggcgcgaagccgtcgtcgtggggcagcggcggcggcgcgggcccggtgtcgatcacgaagggcgaccaggtgccgtcgccgcgggcggacgccatcaagggtggcggtgcgctcttcgacgacacgtcggcgacgagcgcgaccgtgacatcggtggaactgccggtcgccgcccgcacgaaggcggtccagtacacgctgacgtcgtcctccgaccacacggcggcgccggccggctgggtcctcgaggcctcggcggacggcacgcactggacgacggtcgacaggcgcacggacgagtccttcacctgggacagacagacccgggtgttctcgatcgcgcatccgggcaagtacgcccactaccgcctggtcccgacggccgaggcgaccctggcggaggtggaactgctgtcctgagggccccccacgggagagaaggggcggacccggagtcactccgggtccgccccttcggcgtggccgaggtcccggaggtcagttcacggcgagggtgaagacatgcaggtccgtgttgtcggggagcttgatgctcttgatcttcttgccggccggggccgtgtacggcttggtcgcgaagacgtacgtggccaccgggtccttgtcggcgccggcgacattgcggtacggcgtcctcgcgacgacctcgttgccgtactggaccgtgccgccgcctccgccgacggtccagtcggtgaaggacaggtcgaccgggtccgtgctgccgtcggtgtacgtcaccgtcgccttcgtctgctggttgccgttcaccgcgctgccgatgaagctcagttcggctgccggagtggggagttcgacggtccggccggtcgccgaggcgttgtcggggcggcccgccggggagtcgggccaggtgaacgtgaggccgttcaccgtgccctgcgtgcccggggtcagacccgcgcccgccagcgcctggcgcgagtagctccagcccccgccgtcgtagtcggcctcgtcgtggtcgcccacgtcgtccgagacgcccgtgttgtcgtacgcggccagcagtgagccgggcgcggccaccgtcagggccaccggttgctcgtacgacgtgtcgggcgacgtcaccgtcaccttgacgtcgtaaaagccctgcctggccgcgtcggccgcggtcaccgtgatctgctgggcgccgtcggacaccgtgccctcggcgggcgtggccgtgacgccggccggcgtctcgacgcggaagcgcacctcgggtcccgttccgccgctgagcgccagcgccctgatgtcgatcttcgtgctgccgccgggcgcgaccgtggccgtggtggggcccacgccgatctggtacggctgctcgcccgcgcggaaggacggcggcgcgtcggcggcgtcggcaccccaggcgcggttcggggtcgcggagagggtgtagtcgaggcggccgccgtcccgtacgaaggaggcgggcagccaggagcggtcactggtgcggccgtcgaccttcaacgaccgcacgtacggggcgtccttcgccgcgcccgccgcgcggatctcgatgtcgttgccgtgcgggcgcctgatctccacgcgggggaacagcggtgaggccagcacgagttcggcacgggacgggacctgcgggtacatgccgagcgcggagaagacgtaccaggacgacatcgcgccgaggtcgtcgttgcccggaatgccgcccggccgcgtcgaccacagcttgtccatcgccgcgcggaccgtctcctgcgtcttgtagggcgctcccgcgtaggcgtacaggtagggcacgttgatggacggctcgttgtccagctcggacttgtcgccgccgctgccggtgaaggcccagctgccgtcggagtcgtggaagaaggcgtccagccggtcgagcgccgcgtcccggccgcccatggccgcgaacagtcccgccgggttgtgctgcaccatccaggtgtactgggccgccgtgccctccacgaagccgttgccggtggccggggtgaagccggtgacccagctgccgtcggccttccggttggcgatgtagccgctgttgaggtaccccttgcccgagccgacccgggcgctcggggacggggcggccgcgatgttgaagttgttctgccaccactgggagcgccgggcgaaggtcgccgcggtctccttctcccccgccgcccgcgccagttgggacagcgcgaagtcggcgcccgacatctccagggtctcggcggccccgccccacgcgttggagacggacggcatgtagtggcggttcaggtacttgtcgagggagggacgctggccgaccgagaggaccggcttcccggccgccgacaggtcctgcgacgtcggcacggtcgccgccttcaccaacgagtccagtgcgccgcgcagatcgaagtccgtgccgccgaaggcacggataccggcgagggcggccggggacgggtcgccgttcatgacgtgtgtcccgctcgcgccgtgcagccagcggtcccagattcccccgttctgccgggccagttcgagcagcgactgcgcgatgtcggacccggtgcgcggatcgagcagcgtcagcagctgcacctgggagcggtagacgtcccagccggagaacgtgccgtactgggcccggtgcccgcggcccacgacgtgcaccttgtcgtcactgccccggtatctgcggtccgcgtcgctgatcacgttggggtgcaggagggcgtggtagagagccgtgtagaaggtggtgcggtcctccgccgtgccgccgccgaccccgaccgcccccagacgctcgcgccaggcacggcgcgccgcgtcccggacggcctcgaaggagcggccgcgggggttctccaccgcgaggttggcctcggcgcccgcctggctgacgtacgagataccgaccttgacgttgaccggtcccgagccgggagcgaactccacatagccgcccgctcccttgccggcgacgggccgcccgccctgggagaagccgcccgtgccgccgctcgcctccgtggagccggggttcagcctgtcgtcctgccaggtgccggtggacttgaaggcgcggtcgaagcgggcggtgaagtggagggtgtagtagccgcgccggccctcgggatcgaggtagccgcagaagttgcctgaggtgaccgagccggagaccgtgcgggtcgccgggtcgatccgcacggacgaatcggtcgagcccacctcggagttggcggtgcggatcagcagcgaggccggcttgtccgcggggtaggtgaagcggcccgagcccgtgcgcgcggtggccgtgaggtcggcggtgacaccggaggagagccccactttgtagtggccgggctcggccgtctcgtcctggtgactgaagtcggccgcgtacacggcgtccttggtgtcgctcgccggggaggaggtgacgtcgcccgcgtacgggaagaaggggatgtcaccgctgccgcccgcgcagccggtgccggacatgtgggtgaggctgaagccgcggatgcgggtggcgtcgtactggtagccgccgggggcggcggtgcgggtggcgtcgccgcgggtgttctcggggctccaggagagcatgccgaagggggtgacggcgccggggaagacatcgccgccgttcgtggtgccgatgagcggatcgacgtacgtggtggggtcccggacgaggtccggtggggcggtggtcgccgcgagcgccggggtggcgccgccggccaccaccagggtgacggccagcaggacagatgacggacggaaacgcatgacgcggcccctcctccttcggacgggtcgcgcaccacaggtcacacaagccgcagggacagtaacgtgcgccaccggtaccacggaagaccgcgtacgagccggcagacgcgcccccataccaccgctcatcctggtcaactggcttgacatcgttgtcggttaccggagtagagtcatgtacagaccactcagacaacgttgtcgccgccactggtcgtcacaagccacgcttcacccggtccggcctactccccccaggccggaccggctcgcggaccgggtgagccgcaccgcgccacccggtccgccccgagcagttcgccgtcaaccgacctgacaggcgagcgccgtcgacggatcgccgccggagcccctgacgacgtatccgaacgtcgcgctcctccccgggtccagcgacccgttccagtcggcgttgtgcaccatcacgtcctgcccctggtacgtcgcgttgccgttccagaggctgtcgaccgtctggccgctcggcagcgtccagtcgaccatccagccgagcatcgggacgtcaccggtgttggtgacggtgacctcggactgataaccgccgggccagctgcccgtcgtacgacgggtcgcggagcacacgccgggcgggggctcggtggggttgcccgggtcgtggacgcccgtcacttcgccgttgccgccgtcgaagacgacgtcggagcaggagtagaacgtctccgcgctgtccgagcgctgccagaccatgtagacgaggtggcggccagacttgcccgacggaagcctgccgctccaggagtagttggcgtccaccgtgcccggactgccgttgagcggcgggtggtcgacgctcaggaacggctggtcctccatgtcgttccaggtgagcgtcttggtggggtcgaagccgtccttggtcaggtagacgtagaaccagcccgggtgcgccgcccaggcgttgtaggagaagtcgaccgtcgcgcccgacgtcaggtgcgtgagcggccagtcgctgcgcgggaggtcgaagcccgtgaagttggggttgccgccgctgcacagctcgccgtcgggcacgaagccccgggtgcggcccgcaccgtccgagcggagcaccgagaaccagttgtagaacggcgtggtaccgctgacctgctgcgcggccttgcacgccggattgacgggcttgatctcgccggtgtcggtgagtccgtcctgccagcacaggaaggtgcggctgccgggcttcatgggggtgccgtgggctgccgcccttccgcccgccgtgacgaccaggccgagggccgggaccgtggtgaggagggcgagcaggacgaggaggagggctctgtggcgggtggagaggggtaatcgtgcgactgtagggagcatgacaaacatccctctggtcggagtcgtggggattccgcgcgaggtgggagcggtaccctccggcgggttccggtccgccggaatatgggagcgctcccacctcactcgttcgtgaaactagcgcggatgggggcccctgtaaacgtctgacacgcgaggcccgcgcccgggcgggtgcggccgccgctcctggggccggcgccccgccttggaccgccctgccgaggaaccgtcggggaaacgcctgggaactgcccgggaactggcgaggaacctcttctgctccagggacatctacctgtgcgaacagcacgggcagggaggaagcgaagcggtgcggggaccggatgcgggcgacgaccgcgaggccgacgccgacgacggcctgtgggggccggcgctggcgaacctcctcatcgggctgctcgcgatcctcccggccctgtgcctgtgccggctgctgaccccctacccgcaggccggctgcgacggcgggttcgcctgcgccggggaggcccccggccacacgaccggcgtgacgatcggcgccgtgctcggcggagcggcggtcctcgggctggtgctggtggtggacgtcctcatgccacggcaggaggggcggcggatgcgtacgtggctgggaatgaccgtactggtgccgataccgttcgtggtggggcaggcgttcggctggatccaggggtgattcagggtgatccaggggatggcccgggacgtcggtgacgagcgggaagcctagggatgtgcccgcgcggcctccagggcaccggacagtgccgggcttgccgccagttccgtgggctccggctctggggccaggggcagttcgatcgtgaactccgtgtggcccggggcgctgtcgacatggatgcggccgccgtgcgccgccgtgatggccgcggcgatggccaggcccaggcccgagccgcccaccttgccggaggcccgggagcgggacgcgtcggcgcgggtgaagcgttcgaagaccgtgggcagcagagcgggcgggatgccgggaccgtcgtcgcgcacgcggatggtgcaggagccgcccgtggcctccaccgaggcgacgaccgtcgtacccggtggcgtgtgcacgcgcgcgttggccagaaggttcgccacgacctgatggagccgggcctcgtcgccgatgacgagcgccgggacgtcgagcggcagcgccagctgccagtcgtgggtgtccccggcggcccgcgcgtcccacaccgcctcggcgaccagccccgcgaggtcgacctcggccgagtgcaacggccgcccctcgtcgagccgggcgagcaggagcagatcctccaccagacccgtcatgcgtgccgactcggcggagacccggcgccaggccaggttcggctcgatccgctcggtgccgcggttcatgagttcggcgtacccggcgatggaggccagcggcgtacggagttcatggctggcgtcggccaggaagcggcgcatgcgttcctcgctgcggcgcatctcctcctcgccgcgctggcgttcggcgagcgaggactcgacgtggtcgatcatccggttgagggcggcgccgacctgtccggcctcgctgccgaggtcggcgtcgcggtcggggaccctggtgaggccggtgaccctgccgtggcccagcggggagcgggagacctccacggcggtggcggcgacccgccccagcggccgcagctggcgccggatgacgacggcacaggcacagcccgcggcggtgagaccggccgccgccacgacggcctcgaccaggaccaggccgccgatcatgtcctggacgtcccccatcgggagtccggtgaggacccggatccccttgctgtcgagcgcggtgacccggtaggtgccgaggccggggacggtacgggtgtgcttcgagccgtcggtcgcgatgccgtcgagagcggcgcgctgggcggcggtgagcgcgcgcggcggggcgtcctggctgacgacctcggcggcggtgatgtacccgtcgacgtcgagccgggcggcgagcgtgccggcgggctgcccgttctcgtggaggaaccccaggtccgtgtcgttctccggatggagcccggctccgccctggctgcgctcggcggcgtcggtgacgcgctcgtccaggttgccgagcagataggcacgctgggcgaagaccgtggtgagcgtcatcgcggcacagacgacgacgagggtgacaccgatgaacagcagcagccgcgtccgcagcgagcgcgctcgcggccgggccgtcatctgccgtcctccgcggacctgatggcgtagccgagcccgcgcaccgtgcggatcatcggtgcccgccccttgtcgatcttgcggcgcaggttggagatgtacacctccacgagattgccgccgccgtcgaaggtgctgctccacacgtgctcgaggatctgggccttgctcagcacctggcgcgggtggttcagcagcagggcgagcaggtcgaactccttggccgtgagcccgatcggcgtgccgtcgcggtgcacctcgcgggtctcctcggtcaggacgaggtcgccgagcacccgcaccgagtcgtcggcccgggcccccgcggtgccggcccgccgcagcagcccgcgcagccgcaggacgacctcctccagggagaagggtttcgtcacatagtcgtccgcgcccatggcgagcccttcgatgcggcgctccagcgcgtcgcgggcggtcagcatgagcacgggcagtttcggactctcgtaccgcagccgtctcagcacctggagtccgtccaggtcgggcagcattccgtcgagcaccaccgcgtgcggggcgcagccgcgcgcgaggcgcagcgcgctgtggccgtcggccgccgggtagggccgccagcccgcttcggtgacggccacggacaacagctcggtgagcgcgggttcatcgtcgacgatgagcacacggacgcggccgtttcggggcccaggggtgccagacatgtatcgatcgtgtcccggtcacctgagggaacgctgtgttccgcctgagctcaggccatgtcctgaaatgaacggcgaagggccgcatccccggcgacggggatgcggccctcaactgccttgccggaccgcttacttgcggatcaggctgcgcagcacgtactgcatgatgccgccgttgcggtagtagtcggcctcaccgggggtgtcgatgcggacgaccgcgtcgaactcgacgcccgtgtcggtggtgaccttcaccgtgcgcggggtggtgccgttgttgagctcctcgacgccggtgaaggagaaggtctcctcgccggtgaggccgagggactcggcgttcgcgccctccgggaactggagcggcaggacgcccatgccgatgaggttcgagcggtggatgcgctcgtacgactcggcgatgacggccttgacgccgaggagcgcggtgcccttggcggcccagtcgcgggacgagccggagccgtactccttgccggccaggatggccagcggggtgccctgctcgatgtagttgcgcgaggcgtcgtagatgaacgacaccggcgcgcccggctgggtgaagtcgcgggtgtagccgccctcggtgcccggcgcgatctggttgcgcaggcggatgttggcgaacgtgccgcggatcatgacctcgtggttgcctcggcgcgagccgtaggagttgaagtcacgacgctccacaccgtgctcggtgaggtacttgccggccggggtgtcggccttgatggcgccggccggggagatgtggtcggtggtgaccgagtcgcccagcttggccagcacgcgggcaccggtgatgtcggtgaccggggacggctcgtgcgccatgccctcgaagtacgggggcttgcggacgtaggtggactgcgggtcccactcgaaggtgttgccggtcgggatcggcagcgcctgccactgggcgtcgcccgcgaagacgtcctggtaggacttgttgaacatgtcctcgccgatggcgttcgccacgacgtcgttgacctcggcctcggagggccagatgtcggccaggtagaccggcttgccgtcctggtcgatgcccagcgcgtccttggtgatgtccaccttcatggagcccgcgagcgcgtaggcgacgaccagcggcggggaggccaggtagttcatcttgacgtcggggttgatgcggccctcgaagttccggttgccggagaggaccgaggtgaccgcgaggtcgtgctcgttgacggccttggagacctcctccggcagcgggccggagttaccgatgcaggtggtgcagccgtagccgacgaggttgaagccgaccttgtcgaggtagggggtgagccccgccttgtcgaagtagtcggtgacgaccttggagcccggggcgagggtggtcttgacccacggcttgcgggtcaggcccttctccacggccttcttcgcgacgagcgcggcggcgaccatgacgtacgggttcgaggtgttggtgcaggaggtgatggccgcgaccgtcaccgcgccgtggtcgatctcgtacgtcgagccgtcgggggccgtgacgagggtcgggcggctcggcgcaccgttggggcggagcgcgggggcgtcggaggccgggaaggactccttgcccgcctcgtccacctcgtccacgtagttgcggacgtcctgggcgaactgctgggccgcgttggcgaggacgatgcggtcctgcgggcgcttcgggccggcgatcgacgggacgaccgtggagaggtcgagctcgagcttctcggagaagtcgggctcggcggccgggtcgagccagaggccctgctccttggcgtacgcctcgacgagcgcgacctgctgctcgtcacggccggtcaggcgcaggtacttcagggtctcgtcgtcgatcgggaagatcgcggcggtggagccgaactccggcgacatgttgccgatggtggcgcggttggcgaggctcgtggccgccacaccctcgccgtagaactcgacgaacttgccgacgacgccgtgcttgcgcagcatctcggtgatcgtgagcacgaggtccgtggcggtcgtgccgggcttgagctcaccggtgagcttgaagccgacgacgcgcgggatgagcatcgagaccggctggccgagcatcgcggcctcggcctcgatgccaccgacgccccagcccagcacaccgaggccgttgaccatggtggtgtgggagtcggtgccgaccagggtgtccgggtaggcctggccgcctcggaccatgaccgtgcgagcgaggtgctcgatgttgacctggtggacgatgccggtgcccggcgggacgaccttgaactcgtcgaaggcggtctggccccagcgcaggaactggtagcgctccttgttgcggccgtactccagctcgacgttctgcgcgaaggcgtcgttcgtgccgaacttgtcggcgatgacggagtggtcgatgaccagctcggccggcgccagcgggttgatcttcgcggggtcgccgccgagctccttcacggcctcacgcatggtggcgaggtccacgacgcagggcacgccggtgaagtcctgcatgatcacgcgggcgggcgtgaactggatctcctggctgggctgcgcctgggagtcccagttgccgatggaccggatgtggtcggcggtgatgttcgcgccgtcctcggtgcggagcaggttctccagcagcaccttcaggctgtacggaaggcgagccgagccttccaccttgtccagccggaagatctcgtacgactcgtcgcccacctgcagcgtgctgcgggcgtcgaagctgttcgccgacacgacagtctccttcattcatgtgcgcgtacccaccgcaatcctgccgccacgaccatgggccgatccgctaaggtaaggctaagttaggtcacccttaccaagctggcggctgcggggcgccttcggcagatatctcgatgtcgagataactctagtacatgggggcgggctggtcatgcccggaccgcggtgacctgcctctccggacctgggacagtcccagcctttctggggcatcggtggctgctactcagtctttccgggtcggcggttccgacgcgagggtccgccgtccgtgttccgtacgagtcctgactgccgatgatccccatgatcaccgcgcttgtgtcctcccggggcgcggaccgcgtccgaccccggagcggacgggcgccttcaccggagcgtgcctcgaatgttcgccgccgcggtcaactgaccggcagacgcgtccggtccggcccggatcatccggtccgggcagggcccgtcggatcgacgaatcgacggatcggctcagacaggtcagcagcgcgctgccatgcccgcgcattttccgggtattcggtgcgggacgaaagggggcgcgcatgccactcacattccgcaagagcttccgcatcctccccggggtgcgcctgaacataaacaagcactcctggtccctcaccaccggcggcaagcacgggcctcgccacacccacagcagcaccggacgacgtacgacatcgatggatttgcccggacctttcgggtggcgtcgtacccgtacggacaagcgccactgacagctcatcacccgagcggaccccccagcgagcaccatctcatatctgagatagcctcagcctcatggcagacgattacctcgtacgcatcggcaagctcatccgtgacgcccggcagcatcggggctggactcaggcgcagctcgccgaggcgctcggcaccagtcagagcgccgtcaatcgcatcgagcgcggcaatcaaaacatcagccttgagatgatcgctcgaatcggtgaagccctggacagtgagatcgtctctctgggctacgcgggtcccatgcatctgcgggtggtcggcggacgccgtctgtccggctcgatcgatgtcaagaccagcaagaacgcatgcgtggcactgctgtgcgccacgctcctcaaccgggggcgcacggtgctgcgccgggtcgcccgcatcgaggaggtgtaccgccttctggaggtgctcggctccatcggcgtacgcacccggtggatcaacgacggcgtcgatctggagatcgtgccgccggccgagctggagatggaggcgatcgacgaggaggcggcccgccgcacccgctcgatcatcatgttcctggggccgttgctgcaccgcgtggacagcttcaagctgccgtacgcgggcggctgcgacctcgggacgcgcaccatcgagccgcacatgatcgcactgcgccggttcggtctggagatcgccgcgaccgagggtctctaccacgcccaggtggatcgggcggtcacccccggccgcccgatcgtgctgaccgagcgcggcgacacggtgaccgagaacgcgctgctcgccgccgcccgccacgacggcgtcacggtcatccgaaacgcctcgtccaactacatggtccaggacctctgcttcttcctggaggccctgggcgtacgggtcgagggcgtcggcaccacgacgctcaccgtgcacggcgtgccgaacatcgatgtcgacgtggactactcgccgtccgaggacccggtcgaggcgatgagcctgctggccgccgccgtggtcacggagtccgagctgacggtgtgccgggtgccgatcgagttcctggagatcgagctcgccgtcctggaggagatgggcctcgaccaggaccgctcggcggagtacttcgccgacaacgggcgtacgcgtctggtggacctgacggtccggccctccaagctggaggcgccgatcgacaagatccacccgatgccgttcccgggcctgaacatcgacaacgtgccgttcttcgcggcgatcgcggcctccgcccagggcaagaccctgatccacgactgggtctacgacaaccgcgcgatctatctgacggacctcaaccgcctcggcggccggttgcagttgctggacccgcaccgggtcctggtcgaggggccgacccgctggcgcgccgccgagatgatgtgcccgcccgcgctgcggcccgccgtggtcgtcctgctggcgatgatggcggccgagggcacgtccgtcctgcggaacgtgtacgtcatcaaccggggttacgaggatctggccgagcgtctcaacacgatcggcgcgcagatcgagatcttccgggacatctgagcggcgggtgccgccgtaccccatttgacctgctctgatgcgggtctggaaggggtgcggcggcatctctggacttctccgggactttgggccaccgggccaccgggccaccgggccagggagacgaccgactcgccggcctccaactgctcggaggcgtggaagtggcgcggggcacagtggccgtgctcccggttagcggcaggtgtaggtgaaggacgcggacgtcgtgtgccggctgggggactcgatgaccagccgcgctgtcgccttgctggtgcccttgccgtggaaggtccacagcaggcggaggtgcgtctcgtcctgccccctgcccaaccgctcttcgcgcgggcccgaggaggttccgtcactgcggttccactcgtaggtgaacgtgccggccgccccgttggtgttcaccaccgcgaccacctcggctgttccgtcacagccgaggacgctgctcgtctgcgccgtcacctgagtgatccgcaggtccgccgtctgccgttgccataacaaccaggccagcacgatggccaggacgaccgccgccaggcggtatctgcgtagccggtgcagtcggccccagggctcctgctggctcttgcgcttcgccgtgccgcgccagacgtcgacggcggtgtccgtcagccccaggggcgggacgcccggtccgaaatgcaggacgtcggactcgggcgcgggctcggcgctggtccagtgggcgtcgaggacggtcgggacgtaggtggcgtcgtcgacgtctctgatagtcggttgcacatccgggtcctgcaaggtcggctccaggcccggatccggtaactcccacggcaccaccggacgctcaccgcggtccgtcatcctcgcccctccgttcggctcgctgtcacagaccccggtcgaccgacatcagccgggctcgccctccacggccgccggatccccttgccgcggggtcacagctgacgtcgaacccgagccggtgccggtgccggtgccgccggcggagttgccggagtcggtgccgcccgttgacgcgggatcaccgtcgctggtccccgcgttcgagtggccgtgcctcgcatccgtaccgccgttgtccgtaccgccgttgtccgtcccgccgttgtccgtcccgccgttctccgtcccgccgttctccgtaccgccgttctccgtaccgccgttctccgtaccgccgttctccgtaccgccgttctccgtaccgccgttctccgtaccgccgttctccgtaccgccgttctccgtcccgccgttctccgtaccgccgttctccgtaccgccgttctccgtaccgccgttctccgtaccgccgttctccgtaccgccgttctccgtaccgccgttctccgtaccgccgttctccgtaccgccgttctccgtaccgccgttctccgtaccgccgttctccgtaccgccgttctccgtaccgccgttctccgtaccgccgttctccgtaccgccgttctccgtcccgccgttctccgtcccgccgttctccgtcccgccgttcctctcgacggtgttgttcccgtcgtcgggggagtccgtgccgctgtccccggccccaccgccggaacccgagtcggaacgggtgccgccatcggcgggcgcgaggccggcgcctccgtctccgtggccgccaccgccctgggcgccggatgtgccagccctgtcggagtccgggtccgactcggccgtgtcgccgtgctcggtgccccgcgcctccgtcgccgagccggtgtccttccgtgcgtcgagcctggtgacggcctgggcgtgagcgccggcgtgcccttcggccccacccgccgcccagccgctgggcatcaggctcagcagccccaccaccgccacggcggccgcgccggtgagcacatcgccccgcctgcgcagccgactgcgacgccgtgcggtcaacacggtgcgggccagttcggccgaggagcccaccagacgggcgtccaggcgtgagatcgccagcggcaccagggccgccgccaccgcggccagccggctctggccgcgttcctcccagtcgggtccgtacgcgttctccgccgcccactccagttcccgcaggaagtcgagggcactggggggccggagcgccgggtccttggccatgccgtgccggaccagcgcgcgtacctcttccggcaccctgtccatcggcaccggctcgtcaacgtgctggcgctggaagtcccatggttccggcccctcgaacgggcgcacgccggtcacgcactcgtagagggtggcggtcgccgcgtacacatcgccggccggggtggcggcttccaatttccactgctcggggggcatgtacgcacaggtgccgcgcaggttgtggcggtcgccggtgcgcgcggaaattccgaagtccaccagcttggtctggccgtcccagttcaccagcacgttttcgggcttgtagtcgcggtgcaccactccgacgccgtgcgcggcggcgagcccgagcagggaccctttcagcacgacgagtgcggcctcgatgtcggtggatccctcctttttcagcagcgtgcggagtgcggcgccgtaaaccagttccatgacgattgccgcgccctgctcggcttcgacgtactcgtagagccgcgtcacatgaggggatgtcaggccaccgagaagccgggcctcggctcgcaaggcagtgcgaaattccaccttcgaacacagttcctcgttgaggtacttgatcgcgacgttccggccggtcccggcatggcgggcgatcatcacccgaccggcaccgcctttgcccagtttcttcagatcgatatagccggggacggtccatgaatcgtcgccccgttcgactttccacccgtcacgatcggtcgctcctgccatacttccccctggcgttcagttgtgctggggatctctggaagagacacccgagaggagattcttccagcgggaaaagatccaatacagcaagaattttcacagttctgcaaccgttatcgctgacgccagttcaaggaatagtgacaagagtggccttttgtgcagcggatcggaactgtgtggcggctgtggcgattgcggggcggtattcgcccaccgcagcaggtcacgggactcactggtccccttccgggacatctgagcggcggacgccaccgccccttgtccgacctgcgcgcatgcgagtctggggttcgcgccccgcccgaagccggacactccctcgcccgggcgtcagccccgcccgtgctcggccgaccagccccgctcgaggaggtcgaaagcgcggcggatccgctcacgggggtccgggtagccctcgccgaccctgggggcctcgagggcgaatcgggccagggccgcgcaggccgcgtcgtcgtccggcgcgccgatctcctcggcgatggcgtgggccacggcggcctggtgacgcatccacatgcgatgggcgtacgagcggagtaccggcgtgccctcgacgagcgcgcggaacgcggcgatacgcgggtcctccaggttggcgccggaacggatgtgcaggatgccctcgcacagcgccgcggggatcgaccggccgggagcccggtcacgtacggccgacaccagcgccgcctcctgctccgcgtcctcgtcgaagaccagcgcctccttgctcgggaagtgcttgaaaagggtcgtcgtcgacacatcggcggcgtcggcgatgtccttgacgctgacctggtcatagccacgctcaaggaatagatccagagccgcgtccgccagagccttgcgggtggcggccttcttccgctcacggcggcccatcgtcatctcgttcatgacccaaccctacccgcaggttgcctcagtagaagagttgcctcgttgcacttttttatcgagtgtggtcttctgatggagcgccgcccgcaccaccgcggccccgcgcccttcctcttcccctccccctccgtctcctgtgaaaggagcgactcagccatgtccgcgactcgtccctcccggcccggcggcccggccgccgagccggccgccaccccgcccaacgtgcgttggacgctgctcggcgtgatgctcggaatgctgctggcgatgctcgacaacacgatcgtcagcacatcgatgccgacgatcgtcggcgacctgggcggcatggagcacatctcctgggtggtgaccgcctatgcgctggccaccgccgtctccacccccgtatggggcaaactcggcgacctctacagccgcaagcacgccttcctcgccgcgatcaccgtcttcctgatcggctcggtcgcctccggcgcggcacagtccatgacccagctgatcagcttccgcgtcgtccagggactgggtgccggcggcctggccgcgctcgcgttcgcgctgatcggctccctggtgtcgccgcgcgagcgcggccgctatcagggcatgaccgccaccgtgatggcgatcggcaccgtcggcggcccgctcctgggcggcctcatcaccggccacctgggatggcgctggtcgttctacatcaacctgccgctcggtctggtcaccctggtgtggtgccaggtgatgctgcgcctgccggtccagcgcaccaaggcgaggatcgactggctcggcatcctcctgatgaccgtcacgatcagcgcggtggtgctcgccgcgacctgggcgggtacgacgtacgcgtggggctcctggcagatcgtctcgctggccgtcgtcaccgtgctcggcctgaccgcgttcatcgcctcgcagaagcgcgccgtggagccggtactgccgctccgggtgttcgacaccggtaacttccggctggccggagtcatggtcttcgccgccggcgcggccatgttcggcgcgacgctctaccttccgctgttccagcagagcgttcagggcgccgacgcgacgagctccggtctgctgctgttgccgatggtggttccgatcgccctggtctccaacatcgcgggcaaggtcatgtcccggaccggcaagtacaagatcttccccatcctgggagccggcttcctggccgtgggcctcttcctgctgtcgaccatggacaccggtacgtcccgcaccgtcacttccttctacatggtgctggtcggtgtcgggctcgggttcctgatgcagatgaccacgaccatcgcgcagaacagcgtcgagatgcgcgacatgggtgtcgcgtctgcgggcgtcacgctcttccgcacgatcggcggctcgctgggcgtggccgtgttcggctcgctgttcacccgggccaccgaacaccacctcccctcggcggcgtccgggaacgccgacgcctcgctcagcggctccgccgtggaccggctgccgcagggcgccaaggacgcctatctgaccgcggtcgccgacggaacccagcagatcttcctggtcgccgcggccgtctgcctcgccgctcttctcgccgcgctcgcggtcaaggaggtcccgctccgcggcaagcccgtggccgccgaacccgcggagcagccctcggcagagaaggcgcggatttggcgctgacgtatgcgagttcacgcggcagggcccaggacgtgacggagcggacggaagcggcgggacgccgtgcgccggtgatccacgcctacgccgccgacccgaacgcgaccggcgacgcggtggcgaagaccgtggcggggtcggccggctcgacatcctggtcaacaacgcgggcgtgctcctctgtggcccgctgccggacatcactctggattagatcgaccggatcatcgcggtgaacccgcgcgcggccctccccggagcgcaggcgaacccgcggcctcctgcccaccggcgcatgccgggcgggcggacggccgggctgccggcgaggcgcgtgtccccgtccggagccggccgtccgccggtcgggattcaggtcagggccgccggcttcacgggcgcgtgtgtgccgtcgggggtcaccagggtcgcgtggccgaccatgtgcagcatgggcaggtcggaggggtggtcgccgtacgcgtagcagtcggcggggtcgatgtgcgggtggcgggcgaggagttcgcgtgccaggacgcgcttgccgtcgccgatcgcgggcaggcccaggagttcgccggtcaggacgcgcccgcagcgctccagccgggcaccgagcacgtactgcgccccgacctcctccgcgacgaggggcagcagcggcgggaacgacccggagaccagggcgacggccccgccctcggcccggtgccggcgcagggcgtcgaccgtggcggtgatgtagaagtccgcggcccggctgcgttcccggtaccagtggcgggcccggtcctcgacctcgtcgaccgggcagcggcgccaggcccggtggtactcccggttggcctcatcgcgcggcaggccacgagccagccgcgcgtacaggtccgcgaggagctcctcggtgcggcgcgcgccctcggccccgtgccggaactcgaagtagtggcggaggaattcagggccgctcttgcagcggatgagggtctcgtccacgtcgcagaacaccaagtaggagggcgagaggctcttttgatggggtatcaggtcaggactcacgtgcggagacctccagcagtgcggccggctggggtgccgtggccggggggcggggctcggtcagcgaggagaagacggacgtcgcgtagaccatcgccgccgcttccctgcgcagcatctggtgggcggcgaccgtgtgcacgtcgcgccagctgcgttcgaggacgccggggccgccgcaggcgtggacgccggcggtgcggaagagacgttcgaccccgtccacgagcaggtcggcggcggcggcggtgatccggcggttcctgaggacgtccgcctcggcgcgggtgcccgtgtcggcgcaccgggccgcgtcctggaggaggagctgggcggcctccatgtcgtcggccgagcgcgccagggcgtggtgcagacggctgccgtcgtcctgcggccgtccccgggtctgggcccgggccgcccaggacgaccactccgccagcgcgcggcgggccgcgccgagcgccggggcgcagaagagaaggccgccggcgaggtgacccggcacggtgtggcaccgggaccgtcccgggccgggtgtcccggccagcaggtccgccatggggaaggtgcggtgctcgggtacgagggcgggttccagcaccgcggtgtggctgccggtgccgcgcagcccggtgctgtgccaggagtcacgtacgcggatgtcgcccttcggcaccgcgaacatgcgcgaccccgccgcgccctccacgccgggctccggtgcgcacagcagaagccagtccgcgaagtccaccccgctgacgcactcccactcgccgctcagcagccagccggacggcagccggcgcgcctcacccgacggcctgaccgacgcggagatccgtacgtcggggccggccgaccacaggtcgcgctgcccttcgtacggtaagtaggccgcgaaccggctgtgggccgcccacaggaccgcgcaccaggccgcggaggcgcacccctcccccaccgcggtgaccgccgtgagcaggctgtcgaacgtgccctccgtgccgccccaggcgcggggcacgaagtggcgcgcgaagcccgcgtgggtcaggagcgcgacggtctcgtcgccgagcctgcgggcgtcgtcggcggccgtggcatgtgcggcggcgctctcggccgcggccaggacggcgaccggcagcgccggcgacgtatcgttcacgctttcgtccacaggattgtgacgcagcatcatctggcaagcacctcactcgatgattagaattcgttcacgaacgtatcttttatgcttcggtccccgccgtggagccggcaaaggaggggagcgtcatgcccaagcaggcacgcgccctgcgtacctacgaccgtgtactcgacgcggccgcctacgagttcgcccgatacggctacacgaacgcgaacctgcagaacatcgcggaccgcatcaggctgacgaagggagcgctctacgggcatttcgccaacaaggaggaactggccgccgcgctggaccaccacctgtccgccacgctgggggtactgctcaccgaggcccggacatcgccccatccggcactgggccggctgcagtccctcgtcctcggtctgggccggctcttccggacggatctgcgggccctcgcggcgctgcggctcgcggcggagacggcccgttcgaccgccaagccgatacctctgctgacggagacgcacgacctcgtcctccagttggtgcgcgagacacagcaggaggggcactgggacgcgtcgatctccaccaggcctctggcggacctcatcgtggcggccctcttcggcacgttctggacggagaccgacaccggccacccagggtccgacgggaccgtcgacacgatgtgggaggccctggctcaggcgctcggcggcgccccggcccgctgaggccggccacggcccggtgagccgcgggtcaccacgaggcgaaacgtgaccagggagcgcggctgcccacgcacttccaggtcatgtcggcgcgggccagcagcctctcgccctggtgggccgcgacgcgcagagcgcactcttcggtcggcacgccctcggacggacccttctcgagggagagcaaaatcgtttcccccaactcgccgaaggcggcgcagtccagggagaggccggccagggcgaaggcccggtcgccgagcgtcctgcgggacgcctcgtgcacggtgagatggccgagctgccggaagccctccagcatgaccatcagcggtacgtgatcggtggggtggtcgaagagcaccgcgtgatcgcggtcgacccgcagccgccagtcctggtcgggccggtcccgctccagtacgcagtccttccagcgcagccggcccaccctgttcggccgggcgatcctggcgtccggcgcgggacgaggcgggctcacctcgccgctcgcggccggacgcccccgtaagagccggtagcgccggtcgtccagcatcagtcctcgggtgtgaccgcgtccgcaggggcggccgtcgaccgtgagcgtcacgtccagccgcgccccggccggccgtccccgccggtccctctcctcggtccacgtaccgttcagcaccaccgccagcggcgcggcgccgacgcgcagcgcggtcggatccgtgatctcgaagctgacgtcctggccgatgaagcgggacccgaccggcacaccgaagtacgtgtgggccccgtagaagtgggcctggcgcagggtctccgcgaacagcagcggatcgttcagcccgttctcgtccgggtggtagagcgcgtgatcgcgcggccactgggccccgaccgagaacgcgttctcgccggtgcgcacaccgtcggtgacaaacacctcggcgatggagctgcggtgcaccagctctcgtgtcaccggctggaggaaactgagcacttcgaccgtggcacccattgatggcgccttcatggtcctggaatcatcgagtacgacagacatctgaaaacctcgcctccccgtggagcaaccatgcgagcgaacagacgtgcgaaagccttgctaggcatcattaatatacctgcgcgaaggtatattgcaaggctcgacacggtgcgcttccatgggtcaactccccacggtggcaggaaggttggattccgtcggactcgaacagatcggctcggcacgatatggacgtcatgagtagcgagcgcaacggacagagcacccgtctcccggcgggcacccccttcgacgacaccgcccacctcaagcagcagcgtgcgatccgcacccgcggcacgatcctcaacgccgccgccgcggcgttcgccacggacggcttcccccaggtcaccatcaaggacatcgccgacggcgccgagatgaccaagggagccgtctacttccacttccccaacaaggaggcgctcgccgtagcggtgctggaggagttctaccggcgcatgcaggaggccgtcaacggcgctctggagcacggggaccccacatccccgacgaccgtcgtcgacgtgatgaggcgcctcgcccgcgccttccacgaagacgtcttcatccacgccggggcccgcctgcagatcgaacggccgtacatcaaggccgagctgccggtgccgtacgtggggacgctgaaggtgctcaccgagctcctggatcagtgccgcaccgccggcaacctccccaagagcacgaagcccgaggccctggcccgcgcgctcggctccgccgtgttcggcgcccagcacatctcctgggtgctgaacgaccgcgaggacatcgtggagcgggtggaggagatcatcgacgccttcgtgccactgcactgaacgccggaccgcccagcccctgaggtacgggcggtccggcaacgtccggaggtgcggccgtcactcccgccgcgaggtccgcggtgccgtgactcaccagggtgggcacggtcaccgcggcggtcccgcgcaccggtcgtgcgtgacgcggcgcggcccgtaccccgggaggaagggcgcctggaactccccctgcggtgcgcctgaggctccgcgcgtggtcagtcgaggaaggccgcctctatccagcggcgtacacctcgcgggcgcatacggtgcagccgccccaccgtgtcggccacccgacgggggccgcccaccgacagaaacttctcctggaccatctcggagtggcggacgcgggtgtccgggcccgccgcgcccaccgggatcaggcgggagcgggtgaccgtacggccgtcggtcagccgtaccgtgacccgggcgccggtggccttggtggagcgggagaagtcccggccgtcggcctccagcgtgccgacgaggtcgacgagcgcgtcgccgccgaagccgcgcagccacggcgtggccagcgggcccgcctcgcgcaccgcctcgccgaacggcgcgtcggacaggaagagttcgcgggtcatcgccgtgtcgtgctccagccgcacccggcgggccagcgcccagcgtgcggggtcgtccagatgcggtgaggagaagtcgtccaccgagaagtcgccggtcagcagggtggtggcgaccgggtaggggacgtcgaggacgagcgcgcccagcggagaggcggggccgtcgacgtagcgggccgcgcgctcccccgcgaacagcgtgtacaaggacgcctcgacgacgatctcccgcacgtcgtccgggcgcagcgggccgagttcgcggtggatgtcggcggcgcagtccacggccgcgttgatgccggggcccgccggggtgcatcttaaaggagagggtgttggtgtgccagcggctgccgagccccttcgccaccgcctggggcagcggcaccgtcgcgaaccgggccaggaagccgtcctggtgctcgatgatgtcgggcgcgccgcgcagcccggcggcggccgcgtcacaggcgtccatcgcggtgcgtaccggcgtgaaggtgttgaacagccgggcgtcgctggccaggaaggcccgcatcagcggccagttgggcatggcgaaggccagccccagggcgttctcccactggtcggccggggcccggtcgcagtgcagccggccggccaccgcgccggccaggtgggtgtgcacggcgctctgaccgcgcagcgggccgagggtggcggaggcggtgatgcgggccgcgcactcgttggccgcgacgaccgcggtcagcagggagagcccgtcgagctgacgggcgtacgcgaaggcgagcggcaccgcgacggtggagttggacaggtgtccggcgtacgcggtgtcgtcgaggttgagccaggagccgagggcggcgaagacgcccgcggcggctcgcgggtcgcgctgcatggggtgaccgaaggccgccaccagccggcggcccagcgggtgttcgaggccggcccggatcgaggcgatctgggagagcacctggctggccgcgagcttcaggacgcggcacgggatgtgttcggggcgcaggttcgcggcccagtgggacagttcgcgcagcggggtgtccgaggacgggcgcgagcgggcgggccgcgtctgctgctcccactgctcgcacagggccctggccactcgctcgctgagtacagctgccgtcatggcgccacatccattgtgtcagcgtgaaccgggggaacgcccccggtgccggagccggtgaacccggcggcgggagcaccggtccccccggtgctcccgccgccgcgtgtgggggatcaggcgccggggaccttgtccaggaacccgtagacgcccttgatgcggccgtcgtcgccggtgaccaggacgtcgaagccgatcgcgacgggctcggtgcccggcgcggtcaccaggccccactggaagcgggcgaggttgtggtgggtgtccaccgtgccgtgcagctcgaaggagaggcccttgaactgctcctgcgcgccggcgacgacggcaccgaagccctcgtggccctcgacggccgccagcggatcgatgtacggggcgtccggggcgaagagctcggcgatgcccgcggcgcgcttgtccgcgtcggtctcgttccacagggcgaggtactgggtgacggtggtggtgatgtcgctcatggcggtttcttctccttgtgttccgcttgcgggtgaccggcgtgccgtcaggtcggttcgacgcgccgggggtcgtgagaggtctggggggtcagttccgttcgatggccggggcccacacgggcagggctccgggctggacctcgaaggtcgccgacggtccgatgccgtgctggtactcgccgtcgtgctccaggggcagccggcggccgtcggtgcgctcgacggtgatggtgcggccacgcgcgtacaccgtggccgggtgtcccatgtggtcggcgttcagggtgagtcggggtacgtccgcggcggtcacgccgtcgccgatgacacagacgtcgagcagtccgtcgtcgaggagcgagtcgggcaggacgaggtaccggccgccgcggtagcggccgccgccgacgttggccaggacggtcgggccctcgtgcaccacgcgtccgtcgacggtgacgcggcccgggtacgggacgtacgcggcggccgtgtcggcgaacgccttggtgtacagatcccggcccgtcagcgggatgtcccgggccgtgatcagcgcgtcggcgatcactccggagcaggcgcccagatagacgtactgccgggtctcggccaggcgcgccaggtcgtgccggcgcagccgggcgctgccgcccacgcccgagtcggtgaggaccgccttgagggactcggtccaggggcgctccccccacagcatcttgtagcccgagttcccggtgccgccgggcaccacggtgagcgcggcgcggccgggcgcggaggccaggccctgtaccgcctcgcggacggtgccgtccccgccgatgacgaccacgaggtcgggtgcgtgggcgggccgttgcagggcgcggcgcacggcgacggtcgcgtcccccggtgccgtggtcgggtgaagctcgacgtgctccaggcaggagccgcacaactcggtcacttcacggaccagttgggggctgtggctgccggaggcggggttggccaggaccagggcccgggtggggcccagggctgcggcgctgtctgccatcgggcgaactcctcgggatcggggtggcacgggggggcgggtgaccgaacggccgggcgtggccttcatgaggggccggcgtggccttcatgactgtgtcaggaggcgctgacctggtcctgacgtgcggctgacgcccggcgagcggtcggggggtcaggcggacgacgccgccttcggccccgggatgaactgcacgaacgccgccacggccagcgccagtggtgccagcaggtagagggaggcggtgaaggcgtcggcgtaggcggacgtgccggtgccctgtcccaggacgtggtagaagacgacgccgaccagggccacgcccacggcgccgcccacctggctggcggtggacagcacgcccgacgccgctcccgcgtagcgcgggtcggtgccggccagcgcgatggacgccagcggtgccatcaccatggccatgcccgccccgccgaccgtcagccccggcaccagccagccgacggcgccgtccgtgccgatgtgctgcgcggcggcgaacagcgcggccagccccgccgtgagcaccagcgcgccgaccgcgagggtctgccggccgagcgccgcggcgatgcggcgtgcgctgagcgagacggtcaggaagcccacgccgaggggcaggaacaccagaccggactccagggcggtcagccccaggccctgctggaggtagagcgccaggacgaggaagaacgacgccatcccggagtagtacacgaccgcggtgctgaccccgaacgtgaacgaccgctgccggaacagcgcggggtcgaccagcgggctgcggcccgcggcggcgaggcggcgctgctggacggcgaagaccaccagcaggacgggggcggcggccaggctcagccaggtccacaacggccagccctcctgctgtccctcggccagcggcaggacgacggcgaccaggcccgcggagatcagcaccatgcccagggggtcgagccgcgcgcggccctgggcccgggactcgggcaccacccggggagcgaggacgagagccgcgatccccacgggcacgttgaccaggaagcaggtgcgccagccgagtccggcgatgtcggcgtggatcagcacgcctccgatgagctgcccgaagaccccggcgagccccatggtcagcccgaaggcgttgaacgcgcggacccgggccggcccgtcgtaggccactccgatgatcgccaggacctggggccccatcaacgccgaggccagcccctgggcgatccgggccgccaccagctgcgacgcgctgggggcgaacccggcccaggcggaggacagggtgaacagcgcgacgccgatgaggaagagccgccgccggccgtacaggtcgccgagccgcccgccggtgacgagaccggcggcgtacgcgagcgcgtagcccgcgacgatgaactcgacggcggactggctcgcgtggagatcctgctgggtggcgggaatggccacgttgacgatgaagacgtcgagcgtgatgacgaacgtgccgatgaggatgatcggcagggtcgcccagtgtggcgccgagggtggttgccgctcctcggtcgcggctttcttcggggcggcttcccgtggagactccaaggccatcgggccattccttccttgcgtttctctcctgtggtgccgtccgggaaccgggctgtgccgcgttcccggacggaggggggtcaccagggcgggacgtcgaggatctccaccaccgcggcggagaggctgaatcccgctcccgccgcgacgagcagcacgaggtcgcccggtcccaccgcgcgttccttgaccaggtgttcgaggccgaggaactggtcgcccgcgccgatgtggcccaccaggcggccgaggtcccaggtgctctgcttctcggtgaagccgagcacgtcgtagttctcgggccagaccccgcggtggatgagcggtgtcaccacgcgggatatgtcctcgacgctcacctgggcttcggccagggcccgccgggtggtgtccatgagggcggcctcgatgcgctcccaggagccctcggcctcgggggtggccgcgtgctgaaggccgcgttcgcgcagccgcagcggcatttcgaggccgggcgcggtggcgaacggggtcgtcccccggttccaccgctccagggagttgtcggcgcccagggtggcggagacgacacgggcgaagcccttccgtccggacagcaccagagcggtgccgccgtccgcgaagaccaggttgagctgtacgttccagcggtcgacccagggcggggcgaagttgtctccggtggtcagcaggaccgcggaggtgaaaccggcgtcgatgtagccggcggccaggcacagcgagcccagcccggcgttgcagcgctgctggaggtcgaagccgggagcggcccggcccaccgtctcgttcgcgacgtaggccgccgcgggccacatctcgtgcccctggaaaccgcaggacgagtgcaggacgagaccgacctcgtcccgctcgatcccgacggcccgctccagggccagccggccggcgcggacggccatctcggggccggcgacgccgtcggccacggcgatcgactcgtagcccaggttccggtgctcgtcgtcgaccagtcccgccgcgatggcctcctccatggggaccaggtccggcagccaggacgcggtcgaggcgatgtacagatcattctcgaatctcatggcatatcagtccttcagcaaccagggatcgtcgcgatgtcctttccatgggcggctcgggggctgcgttccatggtgggtggggggttgggggtcgaggttcgtcgtacgtcgtacgtcctcgtcgtacgtcctcgtcgttcgtcgtacgtcgctcgtcgtttcgtcggtcggacgggggggccgcggttcgtcgcgggttcggggtcgtctgctgccgtcgtgctctgccgggcgctactgtcccgcagtcccctgatacggcgctgacaccgcccggccgcccgtccgtgcacgggcggccggtgccggaggcggtccggtcctcgctcagctcaccagtgccgagacgacgcgctggagccgctgggcgaagtgcgcggtgacggactgcgcgtgggcgtcgatgtagaagtggccgcccgggtactcgctgtggcccaggtagtcggggctgcgcccggcccagtgcgtcatggcgtccgggtgctcctggagcgggtccgagcggccgccgtaggacgcgagcgggcagctgacgccggccttgtcgtccacgtactgcgcggcgaccctgagatccgcccgcagcgccgggaccaccagggcgagcatctccgggttgtcgtagatctcggccgggaacgagcccagcttcttgatccactcgaccatctcggccgcgggcatccggctctgctcctcggtgggcaggaagaagccctgcggcgaccagccggacatgccgagcatgaccggcgcgggcccgccgtcctcctccatgcggatggccagccggaaggccagctgggcgccgaggcagtgcccgaagaaggcgaacggccggtcgtcgaggtcgtcgagcacggcctcgtgcagggcgtcgagcagcgggtcccagtcctcgaacgtcgcctcgccacggcggttgtggcggccgggcagggtcaccgcctgcggggcgatgtcggacggaagcaggttctcccagtcgcggtagatgatggcgccgctgcccgcgtgcggcagcaggaacagccgtacggaggcgtccagggaaggctcggcggggtggaaccactggccctcgcgggacatctcctggcctatggcactggtcacgacttcgctcctcctacggtgacggtctgcccgccgagcgcgcgtaccgcggggagcagtacctcggcgatttccttcaactgcggctccgggtcgagcgatccgatccggaggacgaggtgccgggcgccggcgcggacatagccgccgagccactcggcacagctctcggcgctgccccagccgtaggcctggatggccgacatctgttccagggagcgtccgtagtagtgggtgatgtagtgctccagctcggacttggcggcggcgctgtcgctgttgacggtgaccgtcgcgtacagggcgggcgtcaccgcgtcggcgccgcggccggcctcctcggcgagttcggcgatcctgcgccgggccctgccgtaggcgtcggcgtccggcaggaacggcagccagccgtcgtagcgggtggccacgcgggcgagcaccttcggggtgtcgctgcccgccagccacagcggcgggccgccgggggtggcgggagcgggcagccggtcgaggcggtccgcctgccagaacctgccgtcgaagtcggtggggttgcccggttccccggagttccacgcggtgcgccagagcgcggtgatctcgtcgaggcggccgacccgtccggcgaaggacgcgccgacggaggcgaactcctcctcggtctcgggcatcgggaaacccgagccgaggccgagtaccaggcggtctcgggcgacgtgcccgaggctcgcgaccatgttggcgccgatcagcgggtggcgcagggcgggggtgagggcggcggtgcccacggtgatccgctcggtggcggccgcggcggcggcgagcacgacgagggggtcgaggcgggggcgggcggtcagggagtcgccggcccacagggagtcgaagccgaggcgctccgcctgacgggcgaagtccaggaggggggccgccgcgtaggcgccgttgatggcctgctcccgggtggggagcaggatgccgatccgcagggctcggtcgggggactgcggttggttcgtcgaccgcgtgtcgtcgggggctgatcgcgcggttccccgcgccccttgcggggcacgtccagggcgctcggcgtccataggtgctgcttcctctctctggcgtatgtggcgtgccgtcactggaccgctgacgtgagcggatcgcgtgccggggcgctcaaccgctcgcgcaccgcgcgccgcaggatcttgcccgacgggttacggggcaaggtgtcgacgaagtggtaggcgcccgggatcttgtagtcggcgagatggccgcgcagggacagcaggagttcgcgcggactcgcctgggcaccggggcgcagcacgacggcggcgtgcacggcctcgccccagcgcgggtcgggcagcccgacgaccgcggagtccgcgacggccgggtgggcggcgagggccttctcgacctcggccgggtagatgttctgcccggcgacgatgatcgtgtcgttcatgcggtcgcacaggtagatgtagccgtcctcgtcgaggtagccggcgtcccccatgtgcagccactcccccaccagggtgcgcccggtggcctcgggcaggttccagtagccgagcatccgggagggggcgcggacgcagatctggccgatggccccgggcggcagttcggcgccgtccgggccgaccaccttcacctcgttgccggggcagggcttgccgacggactccaggaccgtgctgcccgggtggtgcgcctcgggcggcaggcagaccgccacgctgccggtctccgtgctggcgtagatctgcgcgaactcgcagtcgaacgtctccaggcactgcttcagcagcgtctcggacatcggggcggccccgtagcagatcttgcgcagggagacgaacgcgtcgggcccggcggtccgttcgcccgccatcatctggagcatggcgggcgcggcgaaggtggtggtgacccggtgggtacggatcagccgcaccgcctcctgcgggtcgaactggggcatgatcacgctggtgccgccggcgttgaaggtgtgcatgaaccagccgatgccggcgatgccgaagcccggcagcgagatgagggcgacgtcgtcgggcagccagtcgatccaggcgacgtcgtggtcgcgcatggcctgcggcagggtgaagaagctgcggtgggcgaggacggcgcccttgggcagtccggtggtgccgctggtgtagatctgcacgacggcgtcgtcgggcccggtgcccggctccaggtcggcgtcgggctggtccgcgtaccaggcgggcagtccggcgccgcgggccggttcgccttcggcgtcggtgccgtcgatccggatcatcgtgtggaattccggcaggtgcgggcggaccttggtggcggtggcccagaactcgtcgtcgacgaagacgagggtggcgcccgagtcgcgcaggatgtggtcgacctcgtccggggtgagccgccagttgaccgggaccagcaccgcgccggccttggcgcaggcgaggatcaccaggtagtagttctccgactcgcgccccaggtaggcgacccggtcaccgcgctgtacgccactgacgcgcagggcgtgcgcggcgcggttgctctcgcggtgcagctttccgtaggtggtgatccggccctcgcagacgatcgccgcgtggtgcggacggctgccggcgtgggcgcgggaggtgtgggtgagtgtccaactcccgttggctgtcgtggtcatgggggcctccccttcgtctgtcgtgggtcgcgtgtccgtggtgggtcaggccgccggcaccgggcacagctgcccgtcgaggaaggcggcgagctgccgtacggtcgggtggtcgagggcgagtgaggcgggcaggggcagccggaacgcctgctccagaccggaggtgacgtgccgcgcgctcagcgggtccaggcccagtgagccgaactcggccgtcgtctccagctcgtcgccggccgtcagacgcaggacggcggcgaccttctcgcggaccacctgggtgatcagagcggtgcgctccggcttcggcagcgcggcgagaagggcccggtcgagcccgtcgtcggcgcggtccggtcggaccaggcggtcgtagaactggtcgccggtctcgctgtccgccgcatggcggtcccagtcgaactcgcccaccacccgctgggtgcgtggtgtgccgccccacagccgggccagggtgtcgagtgcccgggtcggcgagaagaagtggacaccgccgcgttcgatctcccggctgaggtgttcctccaggcgggcggacatgccgaccctggcccaggcgccccagttgacggagagtccgggcaggccctggcgggtgcgccactcggcgaggctgtcgaggccggcgctggcggcggcgtagtgcccctgggcggcgccgccgaggacggaggcgatcgacgagtaggtgacgaagaactccagctccgggaacgaggcctgggcggcctcgtgcagcagccagccgccgtacgccttcgcggcgagctgggcgtcgatggactcccaggtgagttcggagatcagcttcttgtcgtaggacccggcggcgtgcacgacgccgccgaccggatacgggcccgccgccacctcggccaccagcctgcgcacatccgcgggccggctcacatcggcgcgtacgacggcgagttcggcgtcctcggcgagcttcgcgaggagcggcgtggccgcctcggtggcctttccgctgcggctgaccagggtcaggtggcgggcgccgagggcgacgagcttgcgggcggtgaccaggccgaggccgccgagaccgccggtgacgaggtaggtgcggtcggggcggatgtccgcgggggcgtcggtcccggcctgcgcgccggcggacggctcgtccgccgcctcgccgggcaggtccacccacacctgcgtgtccgggtcgaggagggcggtgcgcagggcctcgcccgtctcgtcgaggccgaagtgccgggcgccgtagtggggttcggggtgcggcgcgagcacgacggacgcggacgggacggtgagcgtggagcgcagggtcccggcgtggcgtacgaggacctcgtcgccggtggcgaatccggacccgtcgccggccgcgagcacggtgccggtggcgagggcgccgagcacgggcgggggttcctcctcctcccgttcggcgcgtccggtgtccagggcggtacgggcgtcgtcgtcggtgagcacgacggagccgacgcggacctggacctcgtcggcgtccggcgcccggtccgcggcggccacgagcgcgaggtccgagaggtccccggagtcgggggcgcgcagttcgtagcccccgctccaggtgagcgtggcgtcaccggcgaggagccggcggacatagcggcggccgggccggtgggcgatctggtactcaccggcggcctcggcctcccactcgtcgagcagcggcgcgaggtcgctgcccggggcgaggtcgacgagcgtggcgcggtggcgcgggtactcggtgagcaggacccggccgaagccccacagggtggcggcggccaggtgcccgccgtcgcccgccgggtcgccgggcagccactgggcgccctcggtcaccagccacagccggggcggtacgggctgtcgggcggcgtccagcgcggtcaccagggccagcagcgcgcggtagttgtcctcgcactcggcgcgcatccggtcggcggacatggcgccctgccgctgccgccagacgcggcagacgtcggtgacggtcggcgccagacgcggcagacgtcggtgacggtcgggtcctcgagggccgccttgaggccggtgggatcgctcagccgggtcacgcgcaggccgggctgcccggcgagcgcggcggcccggcccgccgccgggtcgagcaggaggaggtggcggccgccgggagcggtccgcgccggggccgcggcgtcggccgaggagggtgcggcggcggacgtccccgcggccgcgcccggcagggcccgccgtacccactccggccggtgcaggaactggcggcggcccacgcggccctcggggcgggcgaggtggacgccgaggagttcggtgacgggttcgccgttctccaggaggaggatgtcggcgatccggcggtcctgttcgccgtgcacccgggcgaggacgcggagctgttccccgcggggcttgcggaagtggcgtacgcgggagatctcgcgcggcacgaagaccgggccctcggggtcgaggacgacggcggcctgcaccgcggcctccaggagctccgccggcacatgctcggccgcggtggcgtcgcggccggtcagctcgccggtgaccaggccgtcccggtgccgggaggcgtgcagcagcagccgcatgcgcgggccgtgcgggcggccgacggaggcgaggtcggtgtagatgtcctcgtcgtcgatccgctgcccggcgggcgtcagttcggcgtccagctcggcgagttcgcagacgggtacgaccggttcgcgcccggcggcgatccgggcggtggcgtgggtgtcctcctcgcccccgacgagggtgaagacctccacgtcggcgccgccctcggaacgcggtcgccaccgggtcgtcagggccaccgtcgtcccggcgggtatgtgcaggggcgtgagcagtttcagctcgcggacggcgcagcgggtgtgcccgccgaccgcgtcctggagggcgagcagcaggtcgacgtacgcgccggtcggcagcgtcgtacgttcaccgtcgccgaggtcggccagcgcgcccaggtccccggcggtgaactcggccgtgaactcccgtaccccgctggcgaaccgctcctccgtgccgagcagcagatggcgggcggcgccgtaggccgcgcccgtgcgccggggtgcgatggagggcggccggtggtcctcgcgctggaaggcgtaggtgggcagggacgtcttcgcgggggccgggcggcccgcgtggtagccggcccaggagaccggcaggcccgccgtgtagtacccggcgagcgcggccagggtggtgtcggcggagcggtcgccgcggcgtaggctcaccggccacacgtggtcggcggcggtcagaccacgctgggcgagcgcggtcaggtcggaccccggtccgatctcgatcagggcgtgccggccgcgctgggccaccgaccggaggccggccaggaagcgtacgggttcgccgaggtgccgcacccagtagtcgggggtgccgatctcggcggggcgggccggccggccggtgacgttggagatcaggctgatggcgggctcgtggaaggtgatgccgtcaagggcggcgcggaagtcgtcgtacacctcggtcatcagcggcgagtggagggcgtgcgggacagccgtccggtcgacgcgtacgccccgcgcccgcaggaggccggtgacctcggcgagggcgttcgcgccgccggcgatcacacaccggtcgggggcgtcgaccgcggcgagagccaggtccgggtgggcggcgaggagcggttcgacgtcctcggcgggggcggcgacctcggccgtgccgcccttcgcgcgcaccgcccgcgtcagccgcgcgcgggcggcgaccagcgtcacggcgtccggcagactgaacagcccggccacggcggccgcgacgacctcgccgatgccgtgcccgatgagcacgtgggggcgcacgccccaggacatccacagccgggcgagcgcgtactccagggtgaacagggcgggctgggcgtactcggtgcggtcgatcgcctccgggtcggcggcggtgccgcgcaccagtgcggccacggagcggcccaggtgcggtgcgaacagccggtcgcaggcgtcgacgtgctcgcggaagaccgggaaccgctcgtacggcgcggcgcccatgcccgcgtactgggagccctggccgctgaacatgaaggcggtcctgcggatgccggaggggccctcgtggtcccggccggccgcctggtcgagcagccggacgagcgccgcgtggtcggcgaccggtcccgcgacgcggtaggggtggtgggagcggccgacgttggcggtgtagcacagcccggccagcgggacgtcgggccgctgggcgagcaaccgccggtagttccgggcctgttcgcgcagggcggcggcgctcttggcggagagggtgaacaggggggcggcggcgtccggggcggtctcctcggagtgcttcacggcgggcggctgctccaggacgaccgcgccgacggtgcccgcgaagccgaggctgctgacgaccgcgcgccggacgtcggcctgccacggctcgcacgcggtcggtacgcgcacgaagcggggctcccccgcgtcgcgcccggaggacgtggtgcggccggggtgcgggtagaccgtgccggacctgatctggagcaccgccttgatgacgccgacgatgccggacgctggttccaggtggcccaggtcggtctgcaccgagccgaccagcagcggagcgtcctcggtgtgcgactcggcgaagacgcggccgacggcgccggactcgacggagccggccggcgaggtgccggtgccgtgcgcctcgacgtactggatgtcctcgggggcgaggcgggccgcggcgagcgcgccgcggacgaccttctcctgcacggcgccgtcgggggcggccgggcccgcgccgtcgccgtcctgcgcgagggcgctgccgcgtaccagggcgagcacggtgtcgccgtgccgggtggcgtcgccgagccgcttgaggacgacgacaccgcagccctcggcgagcttccccgcaacgcgcgggcggtgtggggcgtcgaccccgccgcacagcgcgatgtcggtctcgcccgcccgcagcccccgcacggccaggtgcagggcgaccagcgaggacgagctcgcggtgtcgacgctcaggctcggaccgcgccagcccaggaagtacgacagccggcccgacagcgcgcacgtggtgacgccggcggcgagggggccgtccggctcctcgtacggcagcggggccggttcgggggcgtagccgcgggagccggcgcccaggtagacgccgccgttgccgcgccgcagcggggtggggtcgatgttggcgtgctcgagggcctgccacgcggtctccagcagcatccgctgctggggatccaggtagggggcctccttcggcgagatgttgaagaaggaggcgtcgaacgtgtcgaggcggtcgagggggccggtcgcgccgcggccttcccgcaggtaggcgtcgaactcgtcgggcgagttgccgccgccggggaggcgcagaccgattccgacgatcgcgatcggctcgggtgcctgccccggcgcccggttcgtctcttccgtctgtgactccgtacgcggcatggagcaactccttgcgtcctgggcctggtcggtcgtcaggcggacggggtggacagggcgtcggccaggtagtccacgagctgggcgaccgtcggctcgttgaacagcacattcacgttgatggacagatcgaggagctgctccaggctctgccgtatctcggtcagccgaagtgaggtgagaccgaggtcgaaataactgatgtcgaggggaagatcctccgactcgtccatgagaagaacagtcttgaacttccgcaggacgagtgtctctatttcatcggcgatttcggtccgcggcagttcgcgcagccgctggatcacggtggtgtcggcaggtggcatggcggtcatgcaagcagcgccggctgacaccccgctgacggcccaagggcgccgcggccggggcctggctgaatcagtccggtgtcagcggggagtcagattcgactgtcacgatcgggctgtttcgaaaaggaattcgccggaacggaaccgaatcggaccgaatcgagaaatccactcgggaagtcggaaaggctgatgatgcttcgcgaagctgcgcaggaggagagtgctccggcaccttccggattgaagagctacgacctctacatcgcgggcaaggatgtcgccggtgacgggtgggtctacaccgtcagcgggcggtccctgctggaagacgtgttcaccagcgtgagcctcaagcgctcgctggagcaggacccggagtccgaggccgcccagcacccctacgtcgtgggccgctgcgcggtcgccgacgacagcgccatcgacatggccacccaggcggcggccgccgccgcctcggactgggcggccgtcccgctggagcggcggatgcgcctgggcacccgcttccgcgaggaactcctcaagcaccaggacgagttcctcgacatgctggtcgccgagtcgcacccggtgaagctggcccgctgggagctgagctgcctgctccagatctacgccccgggcagtctgcgctggtacatgaagcagatgcgggtcgagaaggagtacgcgggccgcaaactgatcctgcaccgtcagcccgacggtgtggtcgccttcaacccgccgcagaacgccccgctgcccagcgccgcgctctgcgtactggccctgatggccggcaacgccgtggtggtcagggcaccccgcagtatcgcgctgagcaccatgtggctgctgcgcgacatcgtggcgccgatcctcgaggagttcgacgcgcctcccggcgtcctcaacgcggtgtgcagcaacccgaagcagaccatggaccgctggatcgccgacccgctgatcaacgacatcttctacatcggcggcagccaggagggcctgcgcttcgaacagcagtgcgtcgcgcacggcaagaagccgatcctcgaactggccggcaacgacggcatcgtggtgtggaaggacgccgacgtgaagtgggcggccgaggccatcaccgagtccttcttcggctccgggcagatctgcatggtccccaactacgtgctggtccacccggacgtcgcggaggcgctgatcgccgaggtgcgtgagcaggtcaagggcatccggccgggcctgcccgaggaggaggacgtcctgctgtcgccggtgcgccgcagcgagcggttcttccggctgctgcgccaggccctggacaacgggggctcgctggtcaccggcggtcaccgcaccgagctcgacgggacgccctcggagacgggtgtcttcctccagcccaccgtcatccgggtggacggcctggaccgggcccgcaccttcgacgtcgtgcgcgaggagaccttcttcccgctcatcccgatcgtggtgcccgaacgcgacaacgacgacgcgctgctggaggccttcctccgcttcgtcaacaccaactcctacgggctgcgcaactccctgtggtcgcgctccgaccacgtcatcgagaccttcgtgcggcgcgtcgtcaacggcggtctgctgaaggtcaacgactctcacatcggcttcctgccgtatctgcccagccacggcggcaccggccgcaccggcggcgcgttcggcgaggccaactacccgatgctcaagacctcgcacgtgcaaggggtcagcatcgcccgcgacatcagcccctacgacgcggtcttcggcgcctgagcgcccgacaccgtccgccttccggaggtttcccgtgcgttccctcgatgctgctcgggccgtctgcgagcaattccaccccggtctgctcaaagagctggagcagatcccgttcacggaccgggaaaagcccggcagtcccgtcatcgacctcttccgcatccacggcggggtcggcctgctgatacccgaggagtacggcggccacggcgccgccccgctggacgcgctgcgcatccagctggcgctgggcgccgtgtccccctcgctcgtcgcggccgtctccatgcaccacttcaccgcggccatgctctactcgctcgccgtcaaggcgggccggctcaccggcgcgcagaccgaactgctgcgccggatcgtccccgaccagcaggtgatggcctccggctgggccgagggccgcaccgagcagaacatcctcacccccgcggtgacggcgcgaccggtcgacggtggatacctgctctccggctcgaagaaaccgtgcagtctgtcccgttcgatgagtctgctcaccgcgagcatcgccatccaccacgacgacggcaccgccgaactggccctcgccctggtgccggccgacgctccgggcctgtccgtccacccgttctggggcaacgacctgctcgcgggcgcggagagcgacgaggtgcgtctgacggacgtgttcgtgccggcgggcatggtcgtacgggcgggggcggacgacccgcaccggctggacgatctccagacggccgggttcgtctggttcgagatgctgatctccgccgggtacgcgggcggggccgccgcgctcgtcgagcaggtgctggagcgggagcgcggcagcgtccaggaacgggccgagctcgcggtcgagatggaggccgccctggcgctcctcgagggtgtcgcacgggcgatcggcacggagccgggcgacgaggagtcggtcgcccgcgtcctggtcgcccgctacaccgtgcagaaggcgctgccgcggatcgccgcccggtccctggagctgctcggcggcctggacttcatccgtggctccgcccacgcccaggcggccgccgccgtgcacgccctcgccttccatccgccgggccgcggcgccgccgccgagccgctgctgcgctacttcgacggcggcgcgctggtcctggcctgagtcaccgcaccgcgggccgtgagcggccgcccccaccacacttggagtgagagatccgtgaccgtcatccaggaatcacccgtcgacaccgaggcggagatcctcggcctgtaccgggcccatctcagcaagggccgggccaccctcgccgagctcttcggcagccacatggagacggcgtccgagggcgcctggctcaccaccagcgacggtgagcgcttcctcaacgcgggcggctacggcgtgttcatcatgggcgcccgccacccgatcgtgatggaggaggtggagcgccagctgcggacgcatcccaccgcgacgcgcatcctgctggagcccaccgtggcccgcgccgccgaggcgctcgtctccgtgctgcccgacggcctggaccgggtgcacttcgcgctgtcgggcgccgaggcggtggagaccggcctcaagctggcacgggccggcggccgcaagcggaccatctcgatgcgcggcggctaccacggcaagacgctcggcgcgctgtccgccaccgccaaggacgtctaccaggcgccgttccggcccctggtgccggacttccagcacctgccgttcggcgaaacggacgcgctggaggcggaactcgcggcccaccccggcgaggtctgcgtcatcctcgaacccgtacagggcgagggcggcgtgatcattccgcccgcgggctacctcaagcgcgtcgaggaactggtccgcgcccacgacggattcctgatcctcgacgaggtgcagtccggtttcggccggctcggcgagtggtggggcgcggacaccgagggcgtggtgcccgacgtgctcctcaccggcaaggccctcggcggtggcgtcatgccggtctccgcggccgtggcgacccgcaaggccttccgccccttcgacaaggacccgtacgtccacaccgccaccttctccgggcagccggtgctgatggccgcggtgcagggcgcgatccgggccatgaaggaggagcgcctggtcacccgggccatggacctcggcgcgcagctgctgccgaggatcgcggagatcgcgtaccgcaacatccccgaactcgtcgtggacgtgcgcggccaggggctgctcatcggcgtggagctcgtcgaggccggactggccggcgagctgctgatcgagctgttcaaccacggtgtggtcgccaaccactcgatgaacggcagctcggtggtgcggttcaccccgcccgccgtgctgagcgacaccgatgtggagttcctcctgaactccttcgacctggccacacgcgacctcgtccggggcgcggccaagatgccggaaggcggtaactgatcgtgcggcacgtagagctcgaagccctgatacccgcggagcaggccacgacggtcttcgactccgtacgacgctgggagcggtacccggacctggcgccccatgtgaagcagaccaccgtgcacgccacctacccggcggaggacgccagttcgagctgggagctgcacttccgcagcgggctgctgcgctggaccgaggacgacgtgttcgtgccggagcggggcgagatccgcttcgagcagagcgacggggacttcgactccttcaccggcacctggaccctgacgcagcagggcgacgacgtcgcggtccgcttcgacgccgacttcgacttcggcatcccgagcctggaggggatcctcgacccgatcgccgagcgggtcatcaaggagaccgtcgcctgggccctgaccggcctgttccccgccgtccgcctctcgggcggcgtcgagctcaccgagcccgccgccgtcggcgtctaggaccgtccgcaggagctgaccatggaccaggcaaatcccttcgagacaccgaggacgtactcgctgcaccgcgccgagtacctggtgggcctcgccgtcaccaccggtctgatcgtcgcccacttcggcgagatccggtggtggcccgcgatcgccctgttcctgtacatcgacctgatcggctacattccgggcgcgatcgccttcaagcgcagcggtgggcagccgatctccaagacgtactacgtgctctacaacgtcatgcacagcctcatcacgcagggcgcggtcgccgcgctgtggtgctggctggtgaagccggagtgggcgcttctggtgctgccgttccatctcttcggcgaccgcggcctgttcggcaacttcatgaagtcgttcgcactgccgttcgagccggtacggcagtccggctatctgcggctcctggacgacctggggctggcccatcccaagccggtcggccacgccgtggagccgaccccggtcggtcacgtcccggcaccccgggtccgccaggagcagcgggaggccgtgcgatgagcaccgccaccgaagtacgtgccccgcggcgtcccgtacgccaggacccggtcgagcgccggcgggcgctgtaccacctggcgtccccggtgtcggtgctgacggtcggccccgaggagcggctgcacggcaccacggcgagcaccgtcacgctggtgtcgcgcgagcccctgctggtgggggtcgtgctgcgggcgggttcgtccttcgcgcggctcgccgccgccgaggggcggttcgcgatcaacgtcctcagcgacgaacaggccgtggtggcacgccacttcgcggacagcggccgccccgacggcagcgagcagttcgcgggcctcgcgtggacggcggactcgtacgcgcacgctccgctgatcgcgggggcgctcgcccactacacctgccggttccactccgcgcacgcggcgggcgacagcgagctgctgctcggccatgtcgtccgggccaggaccggcgacggccttcctctgttcagctacgccggcgggctgttcgccggttccctgcgccccgcgaaggaggcggccgcgtcatgaccggttctgtggcacccgaggccgactgggacaaggctcccggtctgctcgacggcgcgaaggatctcaccctcgggcccgaggagtgcaacctcgcctactggttcacctcggtggcgcagggcacgctgcgcgaccggggcgagaccgggcaccatgtgaacgccaccgtgcccgcgttcctgaaggagccggggccgctgcgcgacgccctggtgctggagttcggcttccgcggcctgtcggaggagatcgcgacgcggctgctcggccactatgtcgcgatcgcccccggcgtccccgaactggagttctacgccactcagttgatcgacgaggcgcggcacgcccgggtcttccgcaatcacctggtggagctgggcatgcctgccgggacgctcctcaaggacatcgacgagatggccgcggactaccgcaagcgggtcctggacccggtcgtggacttcaccctcgacatcgtccgcgaccaggccgacttccccggcggcgtcgccgtgttcgccatcgtcatcgagggtgcgctcgccccggcggccgagctgagcgagcgcaagtggaccccgctgtcgccggccaccggcgagatctcgcgcggcaccgccatcgacgagatccggcatctgacggtggccagcacgatcctgcgcgaccacgcggtcgagcaccccgaataccgcccgcgcctcctggagatcctgcgggccggcgtgcggctgtgggacgagatccccgaccgtgagttcgtcatccaccgcgaggaactcttccaggagggcatggcccagcacgccgacaagatcggcgactacgagatctggccgggcgtccggatgctcgacaccacgccggagcagcgctacgacatggccgagcgctggaccgacgagatggccgagtcgcggatggcgtacatgggcctgcccctggacgtcctcagcagtccggaggccggcacatgagcggcggacgcgcggcggtgatcaccgggatcgggggctatgtgcctcccgatctggtgaccaacgacgatctggcccagcggctcgacacctccgacgcgtggatccgctcgcgcaccgggatcgccgagcggcatgtgatcgcgcccggcaccgcgacctccgacctggcggtggaggccggactgcgggccctgaagtcggcgggcgacgagcacgtggacgcggtcgtcctggccaccacgacgcccgaccagccctgcccggcgaccgccccgcaggtggccgcacggctgggactcgggcaggtgccggcgttcgacgtggccgccgtctgctccggcttcctgttcggcctcgccaccgcgtccgggctgatcgcggccggggtggcggacaaggtcctgctggtcgccgccgacgcgttcaccacgatcatcaaccccgaggaccgcaccacggccgtcatcttcgcggacggcgcgggcgcggtggtgctgcgcgcgggcgccgccgacgagccgggggccgtcggcccgctggtgctcggcagcgacggcgagctgagccatctcatcgaggtgccggcgggcggctcgcgccagcgctcgtccggccccacgaccgacccggacgaccagtacttccggatgctcggccgggacacctaccggcacgcggtggagcggatgaccgatgcgtcccagcgggcggccgaactggccgactggcggatcgacgacgtcgaccggttcgcggcgcaccaggccaacgcccgcatcctcgactcggtcgcggaacgtctcggggtccccgccgaacggcagttgaccaacatcgcccgggtcggcaacaccggcgccgcctcgatcccgctgcttctgtcgcaggcggccgcggccggccggctcggcgccgggcaccgggtgctcctgaccgcgttcggcgggggcctgtcctggggcgcggggactctggtctggccggaggtccagccggtctgacggaccatcacctaccaactcctgtgtgcagtacgccagtccgtacgcgttcgcgtacatccgtcacgtacgccggtttcgcgtacgccatcgaaaggaaccgacatgctggagcagctcaaggaaatcctgtccaacaagctcaaggtgtcgcccgaggccatcaccccggaggccacccgggaggacatcgagctggactcgctggccgtggtggagctgtcgctgctgctcaagtccgaactggacctggacgtcagcgacgacgacctcctggaagccgagaccgtggccgacatggtccggctcatggaggagcggagcgcgaaggtctgatggccggcatggacatcgccgtcaccgggctcggcctggtcaccccgggcggtatcggggtcgggcccagctgggcggcggtctgcgacggcaggccggccgccgccctcgatccggtgctggcggacaatcccgtacgtatctcctgccgggtgcccgacttcgacccggagcaactgctcagcgcacgacgggcgcaccgcctggacaggttcgtgcagttcgctctggtcgccgcccatgaggcggtggccgacgccggtctcgacccgaccacctgggacggggctcgggtcggtgtggtgctgggctgcgcggacggcggtcccggcacggtcgaggagcagcaccgggtgctgctggagcagggcgccgaccgggtgtccccgctgctgctgcccatgcagctgccgaacatgctggccggtcagacggccatcgagttcggggcgaccgggcccaacctggtggtggccacggcctgcgcttcgggcgcgaccgccatcggcacggcccgggacctgctcgcgctcggccgctgcgacgtggtcctggcgggcggcagcgaggcgatgatcactccgctggtcatggccggcttcgcccagatgggcgcgctgtcgcggcgcgaggacgacccggcgtcggcgtcgcgtcccttcgacgccgaccgggacggcttcgtcgccggtgagggcgccgggatcctcgtcatggaacgtgtcgaggacgcccgggcccgcggtgcgcacatccacggccggatcatcggctacggggccaccgcggacgcccaccacatgacgtcgccgcacccggacggcgccggcatcgaggcggcggtccgcgcggctctcgccgacgccggcgcggacccggacgacgtgcagcacgtgaacgcccacggcacgtcgacgccgctcaacgatctggccgaggcacgcatgatccagcggaccctgcagggcgacccgctggtcacctcgacgaagggagtcaccggacatctgctcggcgcggccggcgcggtcgaggccgcgttcgccctgctgagcatcgagcacgagatggttccgccgatcgcgggcctgtgcatccccgatccccggatcgacatcaagctcgcccagtcggccacgtcgatgccgatcgacctcgcgctcagcaattcgtgcgggttcggcggccagaacacggcgcttgcgatcgctccggcctgacggccgggccggtcgcgggccgtcccggcgggcgctaccgaggcaccacttgtgggggcggacggctccgggccgtccgccccgaccggctgttcgcggcacccgcggcacccactttctcgcaccccctcccctcccgctggagtccccatgtccaagatcggttcaccgccgacggatcgccggacggtcgccgtgaccgccccgcccggacggctcgacacccggcacatcctcttcctcatcgtcgcggcggccgccccgctgtccgcgatggtcggcaccgtgccgctcgcgttcgccttcggcaacggcgcgggcgtcccggccgccttcctcttcgccggggtcaccctgctgtgcttctcggtggggtacgccgtcagcgtccgccgcaccggcggcagtggcggcttctacgcctccgtcgccgacggcctcggccggccgcccgccgtcgccgcgggcttcgtcgccctgctcgcgtacaactgcgccaccatcgggctggccggtgcgctcggctacttcacccaactcgtcctggccgcgcacgggttcaccgtctcctggcagtggtgcgccgccgtcggcctgctcgcggtcgccgtgctcggctaccgcgagatcgccctcagcgcccgtgtgctcgccctgctgatgctgggcgagatcggcgtgctggccgccctggacgtggcgatcctggtgcggcacggcctgtccgcgctgcccacggcctcgttctccccgcacacggcgaccggcccgggcctgggcgtggcgctgatgttcgcgttcgtctccttcatcggcttcgagtcggcggccctgtacggcaaggaggccagggacccgcagcgcagcgtcccgcgcgccacgtacgccgcggtcgtcctgatcgccggcttctacgccctcaccagctggctcgcggtgggcgccgtcggcaccggcaaggtgcgcgaggtcgccacccggcagatgggcgacctgttcttcgtcctcggcgacgacttcctcggcaaggccggcagcacgggcctgcagatcctgctgtgcaccagcctgttcgccgccacgctggccctgcacagcgccgccaaccggtatgcgcaggtgctcgcggaggacggtctgctgcccgcctcgctgggcgccgagcacccgaggcaccgctccccgcaccgggcgagcgtcgcacagagcgtcctgacggccctggtcgtcggcggtttcgcggtcgccggcctggacccgtacgccgatctgaccaccagcatgctgggtcttggcaccctgggcatcgtcgtcctccaggcgttggccgccctgtccgtcctcggcctgcggctgcggcggccgggcggcagggcgcactggtggcgggagctggtcgcaccgctgctcggcttcgcgggactcgccgtctccgtgtggctggtggtcggcaacttcgacatgctcaccggctcccccgacccgctgatcgcccgcctcccgtggctgctcgtcgcggtggccgccctcggcctcgggtacgcggcctggctgcgcgccgcccgcccgggccgctaccgcctgctgggcacccgccacctcaccacgtccgacgagcccccggccaccgccgtccccacctcaggagtccgtcatgcacgatcccagtgagctgctcgaagacgggccggccgccgtacggcggctggcccgtcgccgctacgacctcgacctggccgcgctggagaaggcggtgcgccgccggtccgaggcgcaggccgaggtgacccggctgcgcaccgagctgaaccgcacctcgcgggcgcgcggacgctcggggccgccctcggaggaggagaaggaggccgcccgcgcgctgcgcgcggatgtgcagcaggcggaggccacggcccgcaccgcgggacacgacctcaccgagctgctgctcggcatccccaacgtccccctggactcggtgccggacggcgacaccgaccaggaggcggtggaggtccgccgctggggccggccgccgcacgacgccggcaccgacgcccggcaccactccgacatcggcgagtcactcggcatcctggacggcccggcggccgccaagctctccgggtcccgcttcagcgtcggccgcggcgccggcgcccggctggagcgggcgctggccgatttcttcctcgacctgcacaccggcgagcacggctacacggagtactccgtcccgttcctcgtcaaccgcgacaccatgaccggcaccggtcagctccccaagttcgaggacgatctgttccgcacccaggtcggcgaccgggaactgttcctgatccccaccgccgaggtgccgctcaccaacctggtggcccagcagctcctggacgcccgcgccctgccgtacgccttcaccgcgcgtaccccctgcttccgcgccgaggcgggggcgtacgggcgcgacacccgggggatcctgcgcctgcaccagttcgagaaggtggagctggtccgcgtctgcgcccccgaggacgcaccggcgcagctggagctcatggtggggcacgccgaggagtgcctgcgccgcctcgaactctcctaccgcgtggtccagttgcccgcgggcgacctcggcttctcggcccggatgacgtacgacatcgaggtgtggctgccgggcagcgacgcctaccgcgagatctcctcggtctccgactgcggcaccttccaggcccgccgcgccgacatccgtcacaagcgggccgacggccgcaaggccccggccgccaccctcaacggctcggcgctgcccatcggccgcaccgtcgccgccctgctggaacagggggtgcgggaggacggctcggtgctgctgcccgaggccctcgtcccgtacaccggtttccgccggatcctgccgggcggggcaaccgcgtagtactcgcgcggcgaccgcacgacaaagggcgggagtccggggccggtccccggactcccgccctcgggcgtgtccgccctcacgcccccatcatgtgcactccgccgtccacgtggacgatctcgccggtggtgcgcgggaagaagtcggacagcagtgcgaccactccgcgtgcggcggggtccgggtcgacgaggtcccagccgatcggggcccggtgctgccagacctccgcgagttccccgaagccgggaatcgacttggcggccatggagcgcagcggaccggccgcgaccaggttgcagcggatgccgcggccgcccaggtcgcgggcgagatagcggctggtcgactcgagggcggccttggcgacgcccatccagtcgtagtgcggccaggcgaccgtcgcgtcgaaggtgagcccgaccaccgaaccgccgcgccgctccagcaggggcaggcacgcggtggtcagggacttcagggagtacgccgacacctgcacggccgtcgagacgtccgcccagtcgccgtcgaggaaggagaaggcgccctgcggcccgtacgcgatggagtgcaccaccccgtcgagaccgtagtgttcgtcggcgccgtcgacggactcgcggatccggtccgcgagcgtgtccaggtgcgcctggtcggtgacgtccagctcgatcaccgggaccggcttgggcagccgggcggcgatccgctcgatcagggagagccggccgaagccggtcagtacgacctcggcgccctcctcctgcgcgagccgggcgacgtggaaggcgatggacgcctccgtgacgacgcccgtcaccaggatgcgcttaccggcgagaactccgctcatgactgcaccactttctgcggcagggaccggaccagcggggaatcggtgtcgagggcaccgaggggggtgccgccgccgggcgagccgagggcgtcgaagaagtcggcgttggagccgcggtggtcgccccactcggcggggacgtcgtcctcgaagtagatggcctccaccgggcacaccggttcacaggccccgcagtcgacgcattcgtcgggctggatgtagagggcacgccggccctcgtagatgcagtccaccgggcattcgccgacgcaggaccggtccttcacatcgacacaaggcagagcgatgacataggtcatcgtcaactcctcttcagggtaggaatgttcaccggaaccggcgcccggtccaccgacgctccggtggtgcgctcgcccagcgtgaggacggtgacggccagtgcggccatcgcggcggcgatgaccgcgaacagcgcgccgggcccgtacgagtcgaggacgggcagcagcacgaacggcagtgcggcggcactgagtttggacagcgagtaggccgcgccggacgcggtggcgcggatcgccgtcgggtactgctccgagaggtacacgtgcgacacgctggagaagacgttgctgcacagcgtgtagccgaagccgaacgcgacgatgagggcgggcgagtcggtgaaggcgaaacccatgccggccgcgaccatcgcggcggcggacgccgcgaccagcgtcttgcgttcgacgcggtcgatgacgggcagcgacagcgccgagccgacggggtagccgaggaagcacagggccgtgaagcccaggccggccacgatgtcgaaccccttggcggcgaggatctgcggcgccagggtgccgaagccgtagtagccgaccacggagagcgcgcagaagatccacagcatcacggtgcggcgccgcagcccgggcgcgaagacgtcccgcagccggacccgcgcggcgccgggtgcctcgtacggggccgggaggtcctcggccgtccggccggccggcgcctgcgcctccatccgggacaccagccggtcggcctccgcggtgcggccggtcgccgccagccagcgcggggactcgatcagctgccggcgcagcacccacacgacggccgagccgagggcgccgatgacgaacagccagcgccagccgtccacgcccagcggggtcagcggaaccagccacagggccgcgaagccgaccgcgggcaccccgcagaaggcgagcgtgtaggcccaggcgatgaaccggccccgcttggcggcgggcaggacgtcggccagatagcagtcggacagggcctgttcggcgccgattccgatgccggccaggaagcgggtcgcgatcagccagccggcgttgggcgagaaggcgccgagcagggagaagcccgagtagatcgcgaggttgatcaggaaggcccggcgccggccgaatcggtcggcgacccggccgagcaccagcgagccgatgaactggccgacgaacacggaggccaggaccagtttgagcgaggtggcaccgaaggcgaagtcgccctggagcaccttggcgatggtgcccgacagactgttctcgaaggtgtcgaagagcaggcctatgccgatgaccgcggtcagtctgcggtgcatgggcgtgatcggcatgcggtccagacggaccccgatcgagacgggagcggagactccgctcaccgccgtggtggtctgggacatgggcgtggctccttggggaggggaccgcccggggctccggcggacccggacccggacgtgcggcccgggggccggggctgtggtgacggtggtgcggtggtgcggtggtgcggtggtgcggtagtgcggtggccgggaaaaagagaaggccgagaaagcggagaaagcagagaaagccgtggcaggcgaggtagccgagaaaggcggaggaaggggacgtgccggccgccggtcaggcggcctggcccgcctgccgccggatctgctcctcgacgtcgccgcgccgcacgggcgcgctgacctcgtgcaggaaggaggcgacctcgcggtacgaggcccagaacccgacctcgtgatacggcacaccgcgctcggcgcagtaggcgcgggtgagttcacgggcgcgcgccaggttcttctggggcatggccgggaacaggtggtgctcgacctggtagttgaggccgccgtagaggaagtcgatgaacagggaggggcggatgttgcgggaggtgaggacctggcgctccagccagtccagggtctcctcgtcgccgtcgcggacctccatgcccttgtggttcggggcgaagatcatgccgaagtagacgcccagggcggcctgttggaccaggacgaaggcgaccgcgaggacgggcgagaggacggtgaacacgagcgtcagatagaccgccgcccgcgcgaggagcaggaacgactccaggacggggcgcttggtcttgccctgggcgatggacaggacggccgtcttcagcatcttgaaggactccgtgaccagcagcgcgaagaacagcacgctctggtagcgcacgatgaacttctgtgtgccgcgccgggtcgggtactgcttgatgtcgaagatggcggtgcgccggccgatgtccgggtccatgtccaggtggttggggttgctgtggtgccggttgtggtggttgacccaccagccgaagctgaccccgttgacgaggttggcgtggaagtatccgacggcggaggcggccttcttgctgcggaacatggccttgtggccggcgtcgtgccacatgaaggcggactgaccgccgcacaggcccatccacagggccaccacgagctgccaccacgagtcgcccagcgcgaagaacgcggcgaacccgaccagcagcagcgtggtgttcagcgccagccggcctatgtagtagcggggatcgaggtcgagaaggccttccgccttgacccgtttgagcagttcggcgaacgtggccgaagcgccggtgcgctgctggggagcggcggtggcctcggcttcttggacgtgcggacgctgcatgcgttgctctccttggagaagtgcccgaagcgggcggcggcgccgctgccccgcggacctgcgggcgccgcgagtcgacagtgcttccgcgggcggtgacggaacgcgggcggcgcccgcccggcgggcccgggccgctggagcacagcgcggtgctccaccgaaccgggccaccgggcgaacgtgtgtccagcgttccgtgccgcgctgatgtggcactgatactgggctgatcggccctggccgcggggggcttgccgccctgagggccgggcctgacgccgctcaggccgcggcggtctgagcctcgcgcagccggatgtcgagcgcctggacgatgtcgtccgcggcacgggccacgtcctcgtcgtcgggggctccgatgatggccatgagctgcccgaccagggcgtgctggagggattcggtggtcgtggtcccgtcggtcggggtcccggtggccggggtctcttcgctgtcactcactgtttcgactcctcgtcgtgatcgctgtggtgatctcggtggtgggatcggtggtggtcgtggtggtgggatcggtggtgatctgccggcaggtcagaaggccttgcaggcacggaagacgtgcgcgaagccggcgagcgaggcgctcggtccgtcgaaggcgacgtactccgggatgagcgcgtccggggcccacttctgcttgtacgaaagctgggtctgtgccgggtagagagcggcgccctcggcccacagggcgtgcatcagccactggaacgccgggctgtgaccgtcgagttcatggctcgcgtcgaggccggtgaagggcgtgaacccgaagtgcagccactcgacgccctcggcgcggaacacctcgatggcgtgcgcgttgatcgcctccatcaggcccggggagccctcgggtatgcgccggctcaggtcgtgcatccagccggcccgctcgccgtagacgggcgagtacgagatgtacgcgaccggggcgccctcgatggtcccggcgaacagccgtcgctgcgcctgcggttcgccgccgatctggcccaccaggaactccagctgctgtgcgccgcccttggagccgagccaggcctcgtcgatcgtcgctatcgcgtcctgccagtcctcggcggtgacctccttgatctgcaggccgttgcggtgtgcgcgggagatcttgttgcgcagttgcatgaagcgggtgccgcgcagcgagaactcgggcagttgtacggcccaggaggcaccgacctggttgacggtgaagccgcgcccggcgtagcgctcggcgtcggggcgctggagctggacggcgacgaggtgcagcccttcgtccttcacgtactggcggaaggcgtcgaggagggtgtcgtaggcgtcgggggcggcgaaggggccgccgaactggaccgcgtagcggccggtgcggcggtagacgacgacgccgtccgcgcccgggacggtgaacgtgctgttgccgctgttgagcgccaggaatgagctgggattctcgctctgggtgtgtgttcggatcgccccgagaatcgggttgtccgtggtggttgcgggcatgcccgtacccctttcggaagctgtttcttttgatgcgagtagagcaccgacgccgcaccgaggggaagaccggaaaggaattcaacgaccacgtcagagacgtgtcagcgttttatcagaaccctctgccaatgttgttctcgtgaacggcacgggaaaccgaaagccgggaacaaggagaggtgcccggagcggctaaacggggaccgaaggccacgcctcaaggtcgggcttcaaccagcccacgcaggttcgaatcctgccctctccgcgaccacggccagcaccaccggccgcgatcaccaccaggagaggtgcccggagcggctaaacggggaccgaaggccacgcctcaaggtcgggcttcaaccagcccacgcaggttcgaatcctgccctctccgcgaccacggccagcaccaccggccgcgatcaccaccaggagaggtgcccggagcggctaaacggggaccgaaggccacgcctcaaggtcgggcttcaaccagcccacgcaggttcgaatcctgccctctccgctgagacggccgtcagtgcaaaccgtcgccatatggagaggtgcccggagtggctgatcggggaccgaagagcacgtctcgaggtcgggcttcaaccagcccacgcaggttcgaatcctgccctctccgccatattgagtccggtcaacgcagagcaccggaattcgcttttcctggaattccgaaccgttcgccgcatacggactcggagccacggcatccggccaccccgcgcgtcccgccccaagcaccgcgcattccgccgatgccgtaggaaccgccgggcacccccccgtcccggcggagcaaccaccccggcgggccgccaccgagcgcggcccgccggggtgtgggcgtgtcggcgtgccggcgcgccacccaaacggtcattcccgccatctcgacacatccaccccattccgcttacgcgcgctcacagcacaaccgcccaggtcagctcacctcccgccccactcgcaactgattcaacagaaaaataccttctcaaaggaattattctgtgcgaggatgtatgcgggaggaagctccagggcggccccaccacccagcagccccggagatcgccacgcgccggcctccgcgcggtcccaggccgtggtgccgacgaccatgacgaccaccccccacctgtgttcagccgtctttgccgaaccgaatgccaagggggaaacggcatgctgagcttctcgattctcggcgcactccagatccgtaccgcattaggacccgcggagatctccggcgatctccagcggaccctgatccagacccttctcgtgaacgagggccagtccatctccggcgagagcctcgtcgaggagatgtggggcgaggccgtgccggacaaccaggccaacgccctacaggcccacatcagccgcctgcgccgcaaactgaggagcctggagcccgaccggacgacgtcccgggtgaccatccacccctccggctaccggctcacgatcaacgaaagcgagctggacgcggccgagttcaccaagaccgtacgtctggcggaggtcgccacggccgacgacccggcggcgaccgcccggctgctcggcggcgccctcgccatgtggcgcggcccggtcttcggcgacttccccggcggcaccctgtgccaactggcctgcgcccgctacgaggagtaccgcatgcgggccatggagctccgcttcgacgccgagctgcgcctgggccaccacgcggccatgctcgccgagctccacgacgcccacaccaaccacccactgcgggaacgcttctgcgagcagctgatgatcgccctctaccgctcgggccgccaggccgacgcgctcaacgtctaccgccggatgtggcagcacctctcggacgaactcggcatcgagccctcgcccgcgctgcgccgggtggagaacgcgatcctctcccacgacccggccctcgcgggcgacaccccggcaccgatcatcctccagccggcctgagcccgccgcgcccaccggcgcccgccgcacccgccgcccgtgcggcctgaccccgcccaggccgcacggaccgacgccggcccgccccggtcgcacaggcctacgccagccccggcccggtccggcccggccggtatcgcgcgcccgggtcggggcggcccgtcccgcccgtgtaagcccgccgtcagcgcccggtcagtcccgcttgcgacgatccccacggaagacgaaccgcacagaagcagccccctacactcggagacccccatgaccacgagtcagacctcggcccggcccgcgacgacggccggacgtgcggcggcggcccgccccctgcgcacgttcctcgcgctcgacgccgccgtgaccgcggtgaacggcctgatctatctgctcgccgccggtcccgtcggagacctgctcgacctcgacaccggtctgctgcgcggcatcggcgccttcctcaccgtatacggcgtcctcgtggccgtcctggcgtcccgccaggtgccgtcggcggtcgccaccaaggcagtgatcgaggccaacctgctgtgggcggtcgcgagcgtcgccaccgccgtcttcggctggttcgacccgaacaccgtcggcacggtgtggatcccgctccaggccgctgtcgtcgcgggcttcgccgtcctccagatcaacggcctgcgccggctcgccggctgacaccccatcacaacggccggaccgccccgccgtcgggcgagcaggcgatcggggccgccaaccggtaaggggagacatgaggttccaagtcgcggagctggccgagatacgggagcaggtgcacgcaggccccggcgagaaggccaccgccgcacagcacgccaagggcaagctcaccgcccgcgaacggatcggcctgctcctcgacgagggctcgttccacgaggtggaacccctgcgccggcaccgggcgaccggcttcggcctggaggccaagcggccgtacaccgacggagtcgtcacagggtggggcaccgtccagggccgtaccgtcttcgtctacgcgcacgacttccgcatcttcggcggcgctctcggcgaggcccacgccgccaagatccacaagatcatggacatggccatctcggcgggcgccccgctcgtgtcgctcaacgacggcgcgggcgcccgcatccaggagggtgtcagcgctctcgcgggctatggcggcatcttccagcgcaacaccaaggcgtcgggcgtcatcccgcagatcagcgtgatgctgggcccgtgcgcgggcggcgcggcgtactcgcccgccctgacggacttcgtgttcatggtccgcgagacctcgcagatgttcatcaccggaccggacgtggtcaaggcggtgacgggcgaggagatcacccagaacggcctcggcggcgccgatgtgcacgccgagacgagcggcgtctgccacttcgcctacgacgacgaggagacctgcctcgacgaggtgcgctacctgctctccctgctgccgggcaacaaccgcgagaccccgccgtcggtgccgagcgaggacccgcccgaccgccgctgcgaggcgctcgtcgacctggtcccggtggacggcaaccgcccgtacgacatgcggcaggtgatcgaggagatcgtcgacgacggcgagttcctggaggtccacgaacgctgggccaccaacatcatctgcgcgctgacccggctcggcggccaggtcgtcggcatcgtcgccaaccagccccggtccctcgccggcgtcctggacatcgaggcgagcgaaaaggccgcgcgcttcgtgcagttgtgcgacgcgttcagcatcccgctcgtcaccctgctcgatgtgcccggcttcctgccgggcgtcggccaggagcacggcggcatcatccggcacggcgccaagctgctgtacgcgtactgcgacgcgaccgtgccgcggatctcgctgatcctgcgcaaggcgtacgggggcgcctacatcgtcatggacagccagtccatcggcgccgatctcacctacgcgtggccgacgaacgagatcgccgtgatgggcgcggagggcgcggccaacgtgatcttccgccgccagatcgccgaggccgacgatcccgaggccaagcgtgccgagctggtcaaggcgtacaaggcggagctgatgcatccgtactacgcggccgagcgcggcctggtcgacgacgtcatcgacccggcggagacccgcgaggtgctgatcagctctctgacgatgctgcgcaccaagcacgccgaccggccggcccgcaaacacggcaatccccctcagtgacggaggtcccgccccatgaccaccccctgcatacgcatcgagaagggtgcggcgacggacgaggaactcgccgccctcaccgtcctgttcctcacccgggccccccggcccgagcccgacaccgcacccccctcccccggctccaccaccgcctggcgccccgatcccttccacgccccgcacagctggcaggcaccgtgagcgaccacgccgaccggtccggctgcccccggctccacgcgccgggggcagccggctgactcggccgacttcctgcgtgtcctgtccgtgggacgccgtcggtgcgggtgtgcggccggtccacggatgtcccaccgggttcgccgaaggggacacgggcggttcgtcgacgaatggggacgatccgtcggcgcacttccccgtccggctgagggccttgggccggccgccggagacggtggggccgttcctcgacgcggtgggcgacagcccggccacggtgcggtgggacttcatgggctggcccgaggcccccgaagtgggcttgggcgtcgggggagccagaggcgcgttcgtgacgctggccgtgcgtgctcgcgacctcgacctggcggaacccgcgtccgatcacacggtcttcgtccatgtcaagcaggtcgaagccgagcgcgcaccatggctcgccgcgcaggtcgggttgcgggtgatcggcgagctggtggaggcaccgtactgatcggaccgggaaccaagcacccctcccgacccgtcggacacggcctaggccagcaccgcgaagccgtcgagttcgacgagggcctgttcgtcccagaggcgggcgactccgatgacggccatcgcggggtagtcgcggcccgccaactcgcgccagataccgccgagttcgcgggcgtgggcgcggtagtcggcgatgtcggtggcgtagacggtgacccgggcgaggtccgccggaacgccgcccgcggcccgcagagcggtcagcaggttcgtcagcgccctcccgaactggtccggcagcgtctcgccgaccacctttccgtccgtgtcgagcgccgtctggcccgccaggaagacgacgcgggtgccggtgacggcgacggcgtgcgagaagccggtgggcggggagagctcgggcgggttgatgcgctcggtcctcacggggcctccacggtggcgtacaactccttggcgatgacggcccgttggacctcgctcgccccttcgtagatgcggggcgcgcggacctctcggtagaggtgttcgagcaggtggccgcggcgcagggcacgggcgccgtgcagctggacggccgcgtcgacgacgtactgcgcggtctcggtggcgagcagcttcgccatcgccgcgcgccgcggcacgtccggcgccgcctcgtcgtacgccgccgcggccgcgtagaccatgaggcgggccgcctccgtgcgcagggccatctcggcgacctggtgcgccacggtctggaggtcccgcagcttgcccccgaacgcgtcgcgcccggaggtgtgcgcgagcgtcgcgtcgagggccgcctgcgccatcccgaccgcgaaggcgcccacactcggccggaagaggttgagggtgtgcatcgcgacccggaatccgtggtcgggctccccgagcacgtcgtccgccgtcaccggtacggcgtcgaaggcgagcgcgccgatgggatgcggcgagagcatgtcgagcggggtgccggtgagaccgggccggtcggcggggaccaggaaggcggtcacgccacgggcgccggcgccgggggtggtgcgcgcgaagacggtgtagaagtcggcctcgggcgcgttggagatccagcacttctcaccggtgaggcgccagccgtccgggccgtcgggctcggccttcagcgacagcgccgccgcgtccgagccggcgcccggctcgctgagcgcgaaggcggcgaccgcgctgccgtcgctcacccggggcagccagcactcccgctgggcccgggtgccgtacccgtgcaccggatacgcgcccagcccctgtagtgcgagcgccgtctcggcctcggtgcacgtgtacgccagggactcccgcagcaggcagaggtcgagcgccccggcggtgaacagccgttccagcaggccgagtcggcccagttcggcgaccagggggcggttgacgtggcccggctcgcccttctccgcgagcggccgcagacggtccgccgccagcgtgcgcagctccgcccgccgggcggtctgtgccggatcgagcgagaatgcggtcattgccggtcccctctccagtgaccctccgacggtatcgcggaccgttgactgtcgtcaccaacacgatacgctcgatgcgcgagcccaccacgacaagggggcgaaccgccatggacccgaggaacggcacggatcccaggaacggcacggatcccaggaacggcacggactccgggaacggcacggccccccgggacgccgtcgacgaccggcggcccacggcctccgcccacgtcgacaccttcgcccgcgaccacctcccgccccccgaacagtggcccgaactccacttcgacctgccggagctgcgctaccccgaacggctgaactgcgccgccgaactgctcggccgcaccgacgccgggcgcccggcgttccgtaccgcggacggcgacgtctggacgtacggacagctgcgcgcccgcgtggaccggatcgcccatgtgctcacctcccggctcggtgtcgtccccggcaatcgcgtcctgctgcgcgggcccaccaccccctggctggccgcctgctggctggccgtgctgaaggcgggcgcggtcgccgtcacggtgctcgcccagcagcgtccgcacgagctggcgaccatgtgcgggatcgcgcgggtgacccacgccctgtgcgacgtacgggccgtcgacgacctggcgaaggcggaggtccccgggctgcgcctcaccacgtacggcggcgacgcccccgacgacctgctgcgcctgcccgcaccggacgaggcgtacccggccgtggacaccgcggccgacgatgtcgcgctgatcgcgttcacctccggcaccaccggccgccccaaaggctgtatgcacttccaccgggatgtgctggcgaccgccgacaccttctcgaagcatgtgctgcggccacaggaggacgatgtcttcgcgggcagtcctccgctcggcttcaccttcgggctcggcggcctcgtcgtcttcccgctgcgggccggggcctcggccctgctgctcgaacaggccggtccccggcagctgttgcccgcgatcgccgagcaccgggtctccgtgctgttcaccgcgccgaccgcgtaccacgcgatgctcgacgagctgccggcccacgacaccggatcgctgcggcgctgtgtctcggccggtgagaatctgcccgccgccacctggcgggcctggcacgagcgcaccggcctgcggatcatcaacggcatcggcgccaccgagctgctgcacatcttcatctccgcggccgacgagcggatccggcccggcatgacgggcgttcccgtaccggggtggcacgcgcgcgtgcaggacgagaacggcacgcccgtacccgacggcgagccgggactgctcgcggtgcgcggtcccgtgggctgccgctatctcgccgacccgcggcagcgggagtatgtgcggggcggctggaacgtcaccggtgacacctatgtccgcgaccccgacggctacttccgctatgtcacccgcgccgacgacatgatcatctcggccggctacaacatcgccgggccggaggtcgaggacgccctgctgcggcacccggacgtgaccgagacggcggtcgtgggacggccggacgaggcgcgcgggcaggtcgtggtggcgtacgcggtgctgcgggcgggcgcgcgccgggacgcggaggcgctcggcgcgttcctcagatccgaactggcgccgtacaagtgtccgcgcgagttcgtcttcctggacgcgctgccgcgcacggcgacgggcaagctccagcggttccgcctgcgcgacaaccgccgtacggacgtcgactccgtacccccggaagcctccgtccccgcggaaacctccgtacccgcggaagcccccgtgcccgcggaaggtgatcatgagtgacgtggacgatctagagtgatcaacgtgtccgatcagcacgctccccggtccctcatcgtcacgttctacggcgcgtacggccgcttcttccccggcccggtgccggtggcggagctgatccggctgctcgccgccgtcggcgtcgacgcgccctccgtcagatcgtcggtgtcccggctgaagcggcgcggcctgctggtgccggcccgcacggcggccggcgcggccgggtacgcgctgtcgccggacgcccgccaactgctcgacgacggcgacctgcgcgtgtacgcgaccactcccccacgggacgagggctgggtgctcgcggtgttctccgtgccggagtcggaacggcagaagcggcatgtactgcgctcgcgcctggccgggctcggcttcgggacggcggcccccggggtgtggatcgccccggcgcggctgtacgaggagacccggcacaccctggggcggctgcgcctcgacccgtacgtcgacttcttccgcggcgagcacctgggcttcgccgcgaccttcgaggccgtcgcgcgctggtgggacctggccgcgatcgccaagcagcacgaggagttcctcgaccgccacgcgcgcgtgctgcacgactgggaggcacgcgaggacaccgagcccgaggaggcgtaccgcgactatctgctcgccctggactcctggcgccacctcccgtacgccgatcccggcctgcccgccgcactgcttcccgaggactggccgggcgcccgctcggccgccgtcttccgggcactgcacgagcggctgcgcgatgcgggagcggccttcgcggctgggacggagacactcgaccccgccggtgaaacgtgatgtgcaccacatagggcggcgctaagggaaccctcaggttcctccgcccctcttctcagattccctacctacggtcgggacgcatgagtctgatgcgcaatctgaaccgggcgctcaccgccactaccggcctccaggtgcgtagggccgccgccgacgccccgccgcagccgaagaagacggccacggcggcgaaaccggccgggcggcccacgccggtgtaccgatgtcccgccgacaaggacctctcgacggaccgactgctgcggcggccggtcttcatcatgtcgcccgtgcgctccggctcgacattgctgcggatgctcctgaacgcccactcccggctgcactccccgcacgagctgcacatccgccgcctggaggtcgactacggcagcaagctgtcgcagcgcgccatgagcgccctggacctggagcgcggcgacctggagcatctgctgtgggaccgggtcctgcaccgggaactggtcaggtccggcaaggacttcatcgtcgagaagacgcccagcaacgcgttcgtgtaccggcgcatcagggactgctggcccgacgcgcgcttcgtgttcctgctgcgccaccccgtctccatcgcccagtcctggcacgagggcgaccccgacaagcgcacctacgacgaggccgcggccgacgcgctgcgctacatgaaggccgtggacaacgcgcgcaagggcatcaccggcggtcacacggtgcgctacgaggacatcaccgccggccccgagcgggagctgcgccggctgtgcgtcttcctcggcatcgacttcgagcccaccatgctggagtacggccggaaggacgactcgcaggtcgtcaagggactcggcgactggcgcgacaagatccgcagcggcagcgtacaggccgggcgctcgctgcccgccgaggacgagatacccgagctcctgcggcccatgtgcaaggcgtggggctacagctcgtgaagccgcacgccgaaatagcggaggtctggccgcgcgacggatacatccggctggtcggccgcatccacggccgcccggccgacggctcctggcggcttctggtcacccgccgggcccgcgccgaacagcggctggactaccgggcccgcgtcgagggcgaccggttcgagagcgagctgcccatcgccgacctcgccgtccccgacggtgccggagtcgaggagtgggacatccatctcaccgacggcgcggccgagttgcgggccggccggcggctggacgacatctgcggcaagaagaagatcatggtgttcccccggcagctcacccaggacctgagcgtgcggccgtactacacggtcaaggacaacctgtcactggagtgccgtacgggagccgcctcgtgacggaccgtccgccgctccctcgggtccgctatctgctgctgcacgcctatggccgcggcggcaccatccgcacggtgatgaaccaggccaactccctggtcgccgcgggctgggacgtcgagctggtgagcgcggtgcgccgccgggacgacatccagttcccgctcgacgcgcgcgtgaaggtctccaccgtcgtcgacctgcgcgaggacgcccacgtcccgccggccggtccggtggcccgctggcgcgaccggcgccgcggccggctgctggaccggcccgcacggcacatccccgcgggcgagttcggctaccgctacttcaaccggtacgtcgaggaacgcctcatcgcctacctgcggacgctgaccgacggcgtcctcgtcaccacccggcccgcgctcaacttcctggccgccgagcacgccagccgcggcgtgatccgcgtcgcgcaggagcacatgaaccacggcacccacaagcgggacgtgcagcagcgcatccgggagacctacccgcgcttcgacacggtcgccgtgctgaccgaacgcgaccgcgaggagtacgaggcactgctgcccggcacccgcgtcgtccgcatccccaacgccgtgcactcgctcgaccaggtgcccgcccgcccccggtcgaagatcgcggtggcggccgggcggctcttcccgcagaagggcttcgacctgctgatccccgcgtgggcgaagctcgtcgaggcgtaccccgactggcagctgaggatctacggcagcggcgagaagaaggccgagctgcgtgccctcatcgaggagcaccacctctacaaccacgtgttcctgatgggccacaccgaccggctggacgacgaactcgccaaggcctccttctacgtgctcagttcacgcttcgagggcctgccgatggtgatgatcgaggcgatgagccactccctgccggtggtcggcttcgactgcccgaccggcccgtcggacgtgctcacccacggagtcgacggtctgctcgtgccgccggaggaccccgacgcgctcgccgacgccatggcgaagctgatgaaggacgaggggctgcgcgccgagatgggcgtggcggcggtcctgacggccgcctcctacggcccggacgccgtccacccgcgctgggaagcgctcttcaccgaactcgccacacgccccggccgccacggacaacggcgcccgggcggcgccgcgaaaggaccgcacgcatgaccaccacgtccagggcgcagggagccacggtctggctcgccgggctgccgagcgcgggcaagaccaccatcggccgcatactcgccgggcggctgaggtcgcaggggcaccgcgtggaggtgctcgacggcgacgagatccgccgtttcctctccgcggggctcggcttctcgcgcgcggaccgccacaccaatgcgcagcgcatcggcctggtcgccgaggtgctggcgcgcaacggcgtcctcgccgtcgtcccggtcatcgcgccgtacgccgacagccgcgaggcggtccgcaaacggcacgaggcgagtgggacgccgtacctcgaggtgcatgtcgccaccccggtcgaggtgtgcagcgaacgggacgtgaaagggctgtacgccaggcaggccgcgggccggctgaagggtctgaccggtgtcgacgacccgtacgagccgcccgtggacccggcgctcaccctggagacgcaggggcagacgcccgaggagtcggcgggggccgtgtacgcggtcctggcggcgaggggtctcgtatgacgaccgcggccaccgcttcccaggagaccgacagcccgtacgcgctctcgcatctggacgcgctggagtcggaggccgtccacatcttccgcgaggtggcgggcgagttcgaacggccggtgatcctgttctccggcggcaaggactccatcgtcatgctgcacctggcactgaaggccttcgcacccgcggcgatccccttcaccctgctgcacgtggacaccggacacaacttccccgaggtcctcgcataccgcgaccgtgtggtcgccgcacacggactgcgcctgcatgtggcctccgtacaggactacatcgaccgcggtgtactgcgcgaacgccccgacggcacccgcaaccccctgcagaccgtgcccctgaccgaagccatccagcagcaccgcttcgacgccgtcttcggcggcggccgacgcgacgaggaaaaggcccgcgccaaagaacgcgtcttctccctgcgcgacgagttctcccagtgggacccccgccgccagcgccccgaactgtggaacctctacaacggccgccacgcccccggcgaacacgtccgcgtcttcccgctctccaactggaccgagctggacgtatggcagtacatcgcccgcgaacacatcgaactccccgagatctacttcgcccacgaacgcgaggtcttccagcggtcccacatgtggctgaccgccggtgactggggcggccccaaggacggcgagactgtcgagaagcgccgggtccgctaccgcaccgtcggcgacatgtcctgcaccggcgccgtcgactccgacgccaccacgctggacgccgtgatcaccgagatcgccgcctcccggctcaccgaacgcggcgccacccgcgccgacgacaagatgtccgaggccgcgatggaagaccgcaagcgcgaggggtacttctagccatgaccagcaccaccaccgccaccaccgacaccctgcgcttcgcgaccgccggttccgtcgacgacggcaagtccacgctggtcgggcgtctgctgcacgactccaagtcggtcctcgcggaccagctggaggccgtggagcaggtgtcgcgcagccgcggccaggacgctcccgacctggccctcctcaccgacggcctgcgcgccgaacgcgagcagggcatcaccatcgacgtggcgtaccgctacttcgcgaccgcgcgccgccggttcatcctcgccgacacccccggccatgttcagtacacccgcaacatggtcaccggcgcctccaccgccgacctggccgtcatcctggtggacgcccgcaacggcgtcatcgagcagacccgccggcacgccgccgtcgccgcgctgctgcgcgtcccgcacatcgtgctcgcggtgaacaagatggatctcgtcgggtacgaggagaaggagttcgaccggatcgtcgaggacttcgcgggccacgcggcggagctggacctgcccggcttcactcccgtcccggtgtccgcgctgtgcggcgacaacgtggtcgagcgctcggcgcacatggactggtacgcgggcccggcgctcctcgacctcctggagacggtcccggtcggcgccgagtcggccggcgccccggcccgcttcccggtgcagtacgtgatccggcacgacggggtccgccactacgcgggccagttggtgtcgggctcactgcgggtcggcgaccgggtgaccgtccacccgtccggcgagacctccgagatcaccggcatcgacgtgctcggcacaacggcgcgggcggcgtacgcgccgcagtcgctgaccctgcgcctggccggacagcgggacatagcgcggggcgacatgatcaccgccggccccgacgctcccgagctcacgcgggacgtccgggcggccgtctgccatctggccgaccgcccgctgcgcatcggcgaccgggtgctggtcaagcacacgacgcggacggtgaaggcactggtcaaggacctggccggcgcgaccgagctgaccgcgaacgacctcggcaggatcgccctccgcacggccgagcccctggccctggacgactacgcccgggtgcgccgcacgggcgccttcctgctggtcgacccggcggacggcgcgaccctgaccgccgggatggcagacctgtcgtaggagcccgagcccgttcgacgccctcaggtccccagtgtcagccggggcttgggggcgtccgtgcggccggactgcgggcgccggctgcctgcccggtagggcgcgggccagacgacacccggccccgtgtagccctgctcggccgccgcgtgcagggtccagtgcgggtcgtagaggtgcggccgggcgagcgcgcacagatccgtacgcccggcgaggatcagcgagttgacgtcgtcccaggaggagatcgcgccgacggcgatgaccgggacgccggcctcgccgcggatccggtccgcgtacggcgtctggtacgagcgcccgtacgcgggctgttcgtcggcgaccacctgcccggtcgacacgtcgatcgcgtcggcgccgtgcgcggcgaaggcgcgggcgatctcgacggcgtcctcggccgtggtgccgccctcggcccagtcggtcgccgatatgcggaccgtcatgggccgctcctccggccagacggagcgtacggcgtcgaagacctcgagcgggaagcggagtctgcgcgcgaggcttccgccgtacgcgtcggtgcggtggttggtcagcggggagaggaagccggagagcaggtaaccgtgggcgcaatggagttcgaggaggtcgaagccgctgcgggcggcccgccaggcggcgtccgtgaactgctcccggatgtcggtgagctgagcacgggacaacgcgcggggcgtctggctccccggcttgtacggcagcggagaggcggccaccagcggccagttgccctcctccagcggctcgtcgatgccctcccacatcagcttggtgcttcccttgcgtccggagtggccgagctgcacgccgatcccgacgcccggcgcccgggtgtgcacgaagtcggtgatccgccgccatgcctcggcctgccgtccggtgtagatcccggcgcagcccggtgtgatccggccctcgcggctgacacacaccatctcggtcatcaccaggccggccccgccgagggcccgcgcgcccaggtggaccaggtggaagtcgccggggacaccgtccaccgccgcgtacatgtccatcggtgacaccacgacccggttgcgcagggtcagtccgcgcagccggaacggggtgaacatcggcggggtgccggacgggcagccgaactcgcgctccacggcctcggtgaagtgggcgtcgcgcagccgcaggttgtcgtgggtgacacggcggctgcgggtgagcaggttgaaggcgaactgccgggagggccggccgaggtacagcccgatgttctcgaaccactccaggctggcccgggccgcgcgctgggtggaggcgacgacgggccgccgctcctgctcgtacgcggccagggcctcgggcagccccggctgttcctccaggcaggccgccagcgccagcgcgtcctcgacggcgagcttcgtgccggagccgatggagaagtgggcggtgtgcgcggcatcgccgaggaggaccagattgccgtgcgaccagcgttcgttgacgaccgtgcggaagtgggtccaggccgacttgttggaccggagggatcgtccgcccagcgcgtccgcgaagatcttggcgcaccgctcgacggactcccgctcgtccagctcggcgaacccggccgcctgccacacctcttcgcgcatctcgacgatgacggtggaggcgtcggccgcatagggatagccgtgcagctggagcacgccgtgctcggtctcggcgatctcgaagcggaacgcgtcgaaggcgaagtcggcggcgagccagatgtagcggcagcggtgcgtctcgacggagggccggaaggcctccgcatacgcctcgcgggtgctgctgtgcaccccgtccgcggcgatgacgaggtcgtacgtctccgtgagccacgcggggtacggcgcctcggtaccgaagcgcagctccacaccgagcgagcggcaccgctcgtgcaggatcccgaggagccgctgcctgccgagcgcggcgaagccgtggccgccggaggtgtggcgtacgccgcggtgcacgatgtcgatgtcgtcccagcgcacgaactcgtccctgagggccgcgtacaccaccgggtccgcgtgttcgatgccgccgagggtctcgtcggagaggacgacaccgaagccgaaggtgtcgtcgggcgcgttgcgctcccagacggtgacctcgcgggacgggtcgagacgcttcagcagcgctgccgcgtacaggcccccggggccgcctccgacgaccgcgacccgcatggctatcgcccctgccacttcggcggccgcttctcggtgaaggccgcgtggaactcggcgtagtccgcgccgttcatcagcagcgcctgggtcgcggcgtcgagttcgacggaggcggcgagcggcatgtccagctcggcggtgagcagggccttcgtctgggcgtacgcgagcgcggggccctcggcgagccggcgggccagggtccgggcggcgtcgtcggcgtggccctcgtcggtcagctcgctgatcagcccgatgcgttcggcctcgggcgcgcggaccggttcgccgagcatgaggagccgggtggcgtggccgagtccgacgacccggggcagcagataggcggcgcccatgtcgccgccggacagtccgacgcgggtgaagaggaaggcgaagcgcgcggaggggtcggccacccggaagtcggcggccagggcgagcacggccccggctcccgcggccaccccgtgcacggccgcgatcaccgggaacgggcactcgcgcaccgcccgcaccacctggccggtcatccggttgaagtcgaggagctgggcggtatccatggccagggtcgcgccgatgatctcgtcgacgtcgccgccggagcagaagccgcgcccctcaccggccagcaccagggcacgtacggacttctcgcgggacagctcggcgagcaggtcgcgcagatcggcgtaggcgccgaaggtgagcgcgttgagcttctcggggcgggccagggtgacggtggcgaccccgtccgcgatctcgaccccgaggtgtttccagtcgggggtgcgggcggcggaaccggtgaagggactcatgacgtgcggcctcctcgggcgggggcggctgtcggtgccggactctcctcgaagttatcactgatttgtgactgtcgtcacgaccgcgcgatagctgtgtcccggcgtgccggacgccgtcaccgagtcacggcttctcgatagcccggtaacggcgggcacagccgggcgcggcgggtcgttcgcgtgggtacgccgtcggtggcggggcgaaggttccgctgcgggcccggcgagcacctctgtccgggtgcgccgtaccattcctgatgttgaaagcaggacagcctgctccatgaacggaccgaccttgcacgagccccccaccccgccggcctcctggcgcgtcgcgctgccgcacaccgccgcggccgtgcccgtcgcccgcgccctggtccgctcggcgctggccgagctgaagcactcggccgacagcgacaccgcggagctgctcaccgccgagctggtggccaatgccgtggaacacaccgcgggcgagggcccgatcgagctggtggtcgagctgctgccgaccggctgccaggtcgaggtgcacgaccccgacccggccccgccgggcaacctcacggtccccggcccccgcgaggagcccgacccctggcaggaacacgggcgcggcctcctgctgatccgcgccctcagctccgcctgcggccatcgccccacgggctcgggcaaggcggtgtggttcagactgcctgtgataccgcctcagcgtcggttcgcgtagcggccgccgacttcgccagccgggagttgcgacgcccgtagagcgcgtacaccaggcagcccgccgccaggaaggcggcgaactggatccaggtcgtccagcccgtctcgtacatcagatagaggcagaagccgacgccgagcaccggtatcacggggtagagcggcacccggaagctgcgggtgaggcccggctcgcggcgcctgagcgcgatcaccgtgacattgaccacggccatgatcgcgagcgtgccgatggtgcacaggttgaccaccgcgtcgagcgacgcgaaggccgccgggaccgcgaagacgagcgcgacgagcagcgtgccggtgaccggcgtcgaggtcttcggcgagacccgctcgaagacgcggggcacgagtccgtcgcgggccatggacatcaggatgcgggtctggccgtacatcaccgcgagcaccaccgaggcgatggcgacgaccgcgccgaaggcgatgaccgcgccgccggccgtggagccggtgacctcgttgacgacgtacgacagcgcggcgggccgaccgccgacctggtcgccgccgatggcaccgatcgcggcgagtgccaccgcgcagtacaggagggtggccaggccgaggcagacgaggatcgcgatcgggatgtcgcggcgcgggttcctggcctcctcgccggccgtggtgatcgcgtcgaagccgatgtacgagaagaacgcggcggtggtgcccgcgccgatgccgccgagaccggcgggcgagaacggggtgaggttgccgtccttgaaggcgctgaacccgatggcgcagaagacgaccaggatggcgagcttcagcacggccatggcggcggtggcccgggcgctctcgcgcacaccacgcaccaggaggaccgaggcgagggcgatcacgacgacggcggggagattgatcactccgccgtcgccggggcccgcggacagcgcggcgggcagctccaggccggtgagactgtccaggagttcgttgacgtactgactccagccgaccgccacggccgagacggacacgccgtactcgagcagcagacaccagccgacgagaaaggccgtgcgctcgccgaggcccgcgtaggcgaaggagtacgaggacccggagaccgggatcgcgccgcccagctccgcgaaggcgaaggcggtgaagacgcaggtgatcgcggcgagaacgaaggagaccacgacggcggggccggcctgggcgaccgagtcggacaggccgacgaagatgccggtgccgacgatggcgccgacgccgaagcagatgagctggaagaggcccatggtgcgcttgaggccatggccttcgaggtcggcgccggattcggcgacgagcagctcgggggacttgatgcgaagtgcgggcatggcgcggtggtgctctttccggtggtgcgggtgcgaccagaggggtgcccccgcccgggcggagccgggagcttgggggaaagtcgcgcgacgggccgcggaagggatggctccgggcccgccgaggatcgtacgggaatcaggtcccgcgaggtgcccgaggtgacaggcgtcgcacgacaggtgcggccgtggctcaggcgagggtggcgaccaggaccgccttgatggtgtgcatccggttctccgcctcgtcgaagacgaccgagtgcgcggactcgaagacctcgtcggtgacttcgagggaggtcagcccgtgccgcgcgtggatctcacggccgatgtcggtgccgaggtcgtggaaggccggcaggcagtgcaggaacttcacgtcgtcgttgccggtggcgcgcagcacgtccatcgtcacggcgtaggggccgagcagccctatgcgctcgtcccagacctccttgggctcccccatcgacacccagacgtcggtggcgacgaagtccgcgccgcgcacgccctccttcacgtcctcggtgagcgtgatgcgggcgccggacgcgacggcgagctgctgagccacctcgacgatcgtctcgtcgggccacagcagccggggcgcgacgatccggacgtccatgccgagcagggcgcccgtgacgaggtaggagttgcccatgttgtagcgggcgtcgccgaggtaggcgtaggcgatctcggtcagcggcttgtcgctgtgctcggtcatggtgagcgcgtcggcgagcatctgggtggggtgccactcgtcggtgaggccgttgtagacagggactccggcgtgcgcggcgagctcctcgacgacgccctggccgtggccgcgatactcgatgccgtcgaacatgcgaccgagtacgcgtgccgtgtccttgaccgactccttgtgcccgatctgcgagcccgccgggtcgaggtacgtcgtggaggcaccctggtcggccgcggccacctcgaacgcgcagcgcgtacgcgtcgacgtcttctcgaacacgagcgcgatgttgcggccccgcagatacagcgtctccgtccgggccttcttggcggccttcagctcggcggccagctcgagcagcccgcggaactcctccgcggtgaaatccagctccttgaggaaatggcggccggcgagggcggtcgggactgtcgccatgggggcgctccagggttaacagggggacgaggacgaagacgcgtggaagtctatacgacatcccacatttctatgcggacgggctttcgggccgccccggccggcggcgctacccgggcacggcgtcccgctccaccggacagctcatacagcgcggcccgccgcgcccccgccccagttcgctgcccgggatctctatcacctcgatgccctgcttgcgcagatgcgtgttggtggtcgagttgcgctcgtacgcgaccacgacgcccggctcgaccgcgaggacgttgcagccgtcgtcccactgttcgcgctcggccgcgtgcacgtcctgcgtggcggtcaggacgcggatctcaccgagcccgagcgcggcggcgatcgcgcggtgcatgtgctccggcgggtggtcggtgaccttcagctccttctccccgacgcccggctcgatggtgtacgagcggagcatgccgagccccgcgtactgggtgaaggtgtcgccgtcgaccatcgtcatcacggtgtccaggtgcatgaacgcccgccgcttgggcatgtcgagcgccacgatggtgcgcgcggacccggccgcgaacagcttgtgcgcgagcatctcgacggcctgcggcgtcgtccgctcgctcatgccgatgagcacggcgccgttgccgatgacgaggacgtccccgccctcgatggtgcaggggtagtccgcctgcccttcggaccagacatggaaggcctcgtcccggaagagcgggtggtgccggtagatcgcctcgaagtgcacggtttcacgctgccgcgcgggccagcgcatggcgttgatggagaccccgtcgtagatccaggcggaggtgtcccgggtgaagaggtggttgggcagcggaccgagcaggaagtcgtcgaggtccatcacatggaagcgcacggagacgggctcggggtgcgcctccaggaactcccgcttggtcatgccgccgaccagcgcggcggccaggtccggggcgggcagggtctcgaaggcggcccgcagatggtcggtggcgagcggcccgtactccttctcgtcgaagacccggtccagcacgagcgtcctggcggccgggatgtccagcgcctcggtgagcaggtcgccgaagaggtggacggcgacaccgcggtcgcgcagcacgtccgcgaacccgtcgtgctccgcgcgggcccggcgcacccacagcacgtcgtcgaagaggagggcgtccttgttgctgggggtgagccttttgagctcgagatcaggccggtgcaggatgacgcggcgcagccgcccggcttcggagtcgacatgcagtcccatgcctccatcctgaccattcgggcgcgtgttcacccgtcggttgtgaggacccgcagcacttgatttcgtccccttgacgataaccggcatgaacgattatcgtcgtagtgacgaaaatacggagggggtccaccacacatggccgacatcacccggcgcttcggctggcgccatctgcgcggcgcaccgaccgcccatgtccggcaccagcgggcgggacggctggtgcacgacgggcccgggctcagcttctggtaccgctccctgaccgccgcgctctccgagatcccggtggacgaccgcgagctggccatgacgttccacgcccgtacgtccgacttccaggacgtggcggtgcaggcgaccgtgacctaccggatcagcgatcctggcgtcgccgccgcgcggctcgacttctccgtcgaccccgacacgggcgtgtggcgcggcgcaccgctggagcagctggcgacgctgctgaccgagacggcacagcagcacgcgctggacgtcctggcccgtacgccgctgtcggcggcgctggtcgacggggtcgcggcggtacgggaccgggtcgccgccgggctcgcggccgagcctcggctgcccgcgaccggcatcgaggtggtcgccgtccgcgtcgtggcgctgcgtcccgagcccgaggtggagcgggcgctgcgcaccccggcccgtgagcagatccagcaggaggcggaccgggcgacgtacgagcgccgtgccgtggcggtggagcgcgagcgtgcgatcgcggagaacgagctggccagccagatcgaactcgcccgccgcgaggagcagttggtcgaccagcggggcacgaacgcccgccgcgaggcggaggagcacgcggcggcggacgccgtgcgcgcggaggcggaggccgcccgcaccgtgcggctggccaaggccgaggcgcaggccgcgcgcgaggtcggggaggcgcgggcgcgcgcacaggcggcgtggctgcacgtgcacgcggaggtggacgtggcgacgctgcacgccctgacggggacgcggctcgcggagaatctgccgcggatcgatagcgtgaccgtgtcgccggacgtggtgacaggactgctgtcccggctcggcgcggccgcgggcgggccctcgggagaaccggcgtgagtctcgcgccgagggtcgtgctggtccatcgcaccacggagtacgaggagttggtggcccggcacggcacacccggtcaggccgccttcttcctggcctcgcgcgggcggagcgtcgacgaggtggccgagcggcaccggcgggcccgccgggcgtgggccgaggtggtggcggcggtgccgctgacgtggcgtcaggcccgggtggagcgacgggacctggaccggttcctgttcgccccggaggacgtggtggtcgtggtcgggcaggacgggctggtggcgaacgtggccaagtacctcgccggacagccggtggtggggatcgacgcggacccgggacgcaaccccggggtgctggtgcggcaccggcccggtgacgcggcggcgctgctcgcgtcggcgcgcagcggtcacgccgacgagctgacgatggtcgaggcggtcgcggacgacacccagcggctgctcgcgctgaacgagatctatctgggagcggcgggtcatcagacggcccgctaccgcctggggctcgacgagtacgggggtgccgtcgagccccaggcgtcatcgggggtgctcatcggtaccgggaccggggcgacgggatggatccgctcggtgtggcaggagcggggcgaaggactgccgttgccggcgcccgtcgaggaccgcctggtgtggttcgtccgcgaggcgtggccgtcgccggccaccggcacgtcgctggttgccggtgaactcaccgcgtccgcccggctgtcggtgaccgtcgagtcggaccggctcatcgccttcggggacggcatggagggtgacgcgctggaactgacgtgggggcagacggtgcgactcggggtggcggcggtcaggctgcggttggtggggtgaggcgcgggggccgtgggccgcagacaccgagggaccgaggacgccaacaggcaccgaggggccggggccgcagacacccgcggaccgcaggcacccggggccacaagccacaggcccgaggccccagaagccacagcacccggcgccgcagggaccgagggcccacggaccgcaaacacccagggccgcgagccacgggcccgaggcgccggaggccgcaggcgtgcggacgcgggccacaggcaccgagacaccacagcccacaaacacccgcgggccgcagacgcccgagccgaaggccacaggcgccgagaggccgggggccgcaggcgcccgcgggccggaggccgcaggcgctgggcgctgtagggggccggggcatcccggccccctacagcgcccgttcgttcacaggcgtgggtccaccggctccgactccagtgccagcaccccgaacaccgcctcgtgcacgcgccacagcggctcgccctccgccagccggtccagggcctccaggcccagcgcgtactcccggatcgccagcgaccgcttgtggttcaggaaccgcccgcgcagccgtgcgaggttctcgggccgcgtgtactccggaccgtagatgatccgcaggtactcccgcccccggcacttgatgccgggctgcaccagccgcccctgctcaccgcgtaccaccgcgcccgccggcttgacgaccatgccctcaccaccgcgcccggtcatctccagccaccagtcgacgccggcctgcaccgactccgggtcgcccgtgtcgacgaagagccgtcgggtggtccccagcagcccgctcgcgtcgtgctcgacgagccggtcgagcagcgcgagctgctcctcgtgcggcacggcggcgagactgcggccctggacggcaaggatctggaacggcgcgaggcgcacaccctccagcccgtccgtcgcccagcagtaccgccggtacgcgtccgtgaacgcggccgcgtccgcggcccgttcgcgctgcctggccagcagctccccgacgtcgacaccgcgcgccgccgccccctcgagcgcggccagcgcccccgggaacaccgccccggacgcggcgccgaccgccgcgtactgcgtacggagcagcccggacgccttcagcgaccacggcatcagctcggcgtccagcagaacccagtcggtctccagctcctcccacagacccgccgcgccgacggcctcccgcacccggccgaggatctcctcggtcctgtccgcgtcgtcgaagaaggggcgcccggtgcgcgtgtacagcgacccggtgggcccgtcggtcccgaagcgctcgcgtgccgcctccgcgttccggcacaccagcgccaccgcccgcgaccccatgtgcttctcctcgcacacgacccgcgcgaccccgtcctgccggtactgcgcgaaggcctcggccgggtgctccaggtaaccgtcccggtgcgaggtcgcggtcggtgccatggtcggcggcaggtacggcagcagacgcgggtccaccgcgaagcggctcatgacctccagggcggccgccgcgttctcctcgcgcaccgacacccggcccgcgtgccgggtctcgacgaccctgcggccgcgcacgtccgccaggtcgagcggacggccctcgtgcccgccgggcgcctcggtggccagcggcttggccggctcgtaccagacccgctccgccggtacgtcgaccagctcgcgttccggccagcgcagcgcggtgagcttgccgccgaagacggcgccggtgtccaggcagatcgtgttgttcagccaggtggcctggggaacgggcgtgtgcccgtagacgaccgccgcccggccccggtagtcctcggcccacggatagcgcaccggcagaccgaactcgtcggtctccccggtcgtgtcgccgtacagcgcgtgcgaccgcacccggccggaggtacggccgtggtacttctcgggcagcccggcgtggcagacgacgagccggccgccgtcgaggacgtagtggctgaccaggccgtcgatgaactcccgcacctgggtacggaactcctcgctctcgccttccatctgctcgaccgtctcggccaggccgtgcgtgtgctggaccttgcggcccttgaggtgacggccgtacttgttctcgtggttgccgggcacgcacagcgcgttgcccgagccgaccatggacatcacgcggcgcaggacgccggggctgtccgggccgcggtcgacgaggtcgccgacgaacacggccgtacggccctcggggtgcacgccgtcggcgtaacccagcttgccgagcagcgactccagttcggcggcacagccgtggatgtcgccgatgatgtcgaaggggccagtgaggtgggtgaggtcgttgaagcgcttctcggtgaccaccgaggcgttctcgatctcctccacaccccgcaggacgtgcaccttcctgaagccctcgcgctccaggtgccgcagggaacggcggagttcacgcgtgtgccgctgaatgacccggcgcggcatgtccgcccggtcggtgcgcgccgcgttgcgttccgcgcacacctcctcgggcacgtcgagcacgatcgcgatgggcagcacgtcgtgcttcctggccagttcgatcagctggctgcggctctcctgctgcacgctcgtcgcgtcgacgaccgtacggcggcccgccgcgagacgcttgcccgcgatgtagtgcaggacgtcgaaggcgtcgcggctggcgctctggtcgttctcgtcgtcggcgaccagaccccggcagaagtcgctggagatgatctcggtgggcgtgaagtgcttgcgggcgaaggtggacttgcccgagccggaggcgccgatcagcaccacgagagagaggtcggtcaccgcgagagtgcgcgccttcatctgagtcccgttcgtcatgcggccttctcctccttcgcggtggtcggcgtgttcgagtgcgccgaggtcatggagaacacggccatctgggtcggcggacccacctcggggtcgtcgggcccgacgggcgtgaactccacgtcgtagccgtgccgttcggcgacccggcgggcccaggcgcgaaactcctcacgggtccactcgaagcggtggtcgccgtgccgggagtggcccgccgggagggtctcccagcggacgttgtactcgacgttcggcgtggtcacgagcacggtcctggggcgggccgagccgaacaccgcgtactccagggcgggcagccgcggcaggtcgaggtgctcgatcacctcgctgagcacggcggcgtcgtaccccttgaggcggctgtcggtgtacgcgagcgagccctggaagagggtgacccgggatgcctgccgctcccccagccggtccagcttgaggcggcgcgcggcaatggtcagcgcgcgcacggacacgtcgacgccgacgatctcggtgaaccgcacgtccttgagcagcgcctgcaccaactggccctgtccacagccgaggtcgagcacccgtgcggcaccggacgcctggagcgccgcgatgatcgcgtcccgccgccgcacggcgagcggcaccggcttctcctcggtgtccgtcgactcgtcgaccgcgttgtcgatctcctcgacctcgctgtcgtcggcctcggccagacggacgagttcgaggcggtccatcgcctgccgggtgagcgaccagcggcgcgcgaggtaccggctggtgatgagtttgtgctccgggtggtccggcagccagccctcaccggcccgcagcagcttgtcgacctcgtccgaggcgacccagtagtgcttggcgtcgtcgagcaccgggagcaggacatagaggtggcgcagggcctcggccagggtcagctccgccgactccaggaccaggcccacgtaccgcgagtcgccccactccgggaacgcggcgtccagcgccacgggccgagccgtcaccgtccagccgagcggctcgaacagcgcgcgcacgatgtccgggccgccgcgggcgggcagcgcgggcacctcgatgcgcagcggcagcggccgggccggcaggtcgggcctcgccgcgcaggtgcccttcatcgcgctggagaacacgctgctcagcgccacggcgagcagcgaggaggccgcgtacgggcggtcgttgacgtactgcgcgagcgcggcgtcgggggcgccgccccggcccttgcccttgccgcgccggaccagcgccaccgcatccacctccagcagcagcgcggccgtgcaccgctcgacgctcgcctcggggtagagaacgtgcgccgtgccgtacgaggtggagaacgcctgcgatttgtcgggatgcttgtgcagcaggaaaccgaggtcggtggcggggcgctctggggtaccggtggcactgatcgtcaggaacacatgaccgagtatgggcggtcggctcgcccccgaccagggattttccccggacgcggagggctgggacgtacctgcgacacgccgccgcccgccgtgcgtccggttgccggtgcctacgcggttcagggcggggcgcctgaggcgagcggtgcatgatggatacatggatcttcgagtcttcacagaaccgcagcaaggcgctacctacgagacgctcctccgcgtcgcacaggccgccgaagacctcaattacgacgctttcttccgctctgatcattacttgcacatgggatccgtcgacgggcttcccggccccaccgacgcgtggatcacgcttgccggtctcgcccgcgagacgcgccgcatccggctcggcacgctgatgaccgccggtaccttccggctccccggcgtcctcgcgatccaggtcgcccaggtcgacctgatgtccggtgggcgggtggagctcggcctcggttccggctggtacgaggccgagcacgaggcgtacgggatcccgttcccgaaggagaagttcggccggctggaggagcagctcgccatcgtcaccgggctgtggtcgacgcccgtcggcgagcggttctccttcgacgggacgtactaccagctcaaggactcccccgcgctgccgaagccggcccaggggaaggttccggtgctcatcggcggccacggcgcgaagcggacccccgcgctggcggcccggtacgcggacgagttcaacattcccttcgcgtccctcgctgataccgagcagcagttcaaccgggtgcgtgccgccgccgaggaggccggccgcaggggcgacgacctggtgtactccaacgcgctcgtggcctgtgtcgggaggaacgacgtcgaggtgaagcgccgggcggacgtcatcgggcgtgatgtcgacgagctgaaggcgaacggtctcgccggctctcccgcggaagtcgtcgagaagatctcccagtaccaggctgtcgggtcgcagcgcatgtacctgcagatgctggacctcgacgacctggatcagctggagctgatcgccgccgaggtcatgccccagctcgaccggtaggtgccgacagctggtcgccgaccggttgccgccgagggttgccgccggccggttgccgccgaggggagcggccgcggtcacggctgagggagagccccgtctctcgccgccagtctgcgcagcatctcccgtacgcggtccctggactcgtccgccgcgtcgatggcctccatgcactgccagtacgtcccctcgccgtccgccgcgctggcgagggcgacgagggccatgccgacctcggcgaggaggtcgccgaggtcgaggagggcctcacgggcgtcccccagctcggtgagctgcgcggcgcgcaagtcggcgacgtccagcgacggcgtgtcgaggacgccgcagccccggcccgccagctccgtcaatcccagggcctcgccccgcagttcgggcgggcccgacaccgcgaggcggctgcctatcgcctgcgccagggcgtacgcctgccacgcctctgtcatgatctgcggcgccgcgtcgctccccgccagggcgcgcctgctcgccacgatgagccgcaccacgtccatgcgctgcccccgctctgtgtcgacgcgctctccacgcgcccgcccgaactccgttgtccactacccagagtgaatgccatcgggacgaaaagccagaggtagcccgaaatctgtggacaacaaatcggctggggacaactcgatgactccggagagtgacgaacgggcgagcaggaccccgctcgtcgccctcagtcggtccccggcaccggaaaccgcttctcgttgcggtcgatcttcgcgtccagggccgcgagcgcgtcgatgtccagcacctcgcacagctggagcagatacgccagcacgtccgcgacctcgtcggtgacgcggtgggccgtgtccgggtcgtccatcacccgttccgactcctgcggggtcaaccactggaagatctccacgagttcggacgcctccacgctgagcgcggtcgccaggttcttgggggtgtggtacggctgccagtcgcgggcggccgcgaagtccgccagccggcgctgcagatgggctacgtccagttccttcacgcgctcaggtctaccaccgtgaccccttccgcccccgccgcccaggacgtatcactcaccgcgcccaccagccggatgtgcccccgctcgcacatccgcgccgccagccgcaccagctcccgcgcctgccggggatccatgcagcggtcgaggccgtcggccagcaccgtcagcgtctggagcgcctgcggcacctcgccggccgggtcgacctccaggacgccgggaccggtgagcaggacgagcgccagagccgcgtaccgcaactcgccgtcgcccagcagcgccagtggcgtacgggacccgtcgccccggtcgagcagtgcgcgtaccgtgccgtcgcctgccggttccgccagcatgtcctcgaccgggcccgcgcatcccgcgcgcaccgcctcgaccagcagcgcgtgccgccgtccgcactccgaccgcgtgcgccacagcacatcggcgaggttggcgcagcccggcagcagccgtcccgtgcccagcggcgccggggcgcgcatccggtgcggtcgcgggtcgcaggcgaagaccgagcgcagcgcgacgaccatctgctcggcggccgccagcacccggcgctggccgtccgtcttgccggccacccgcaggggcagcagggcggtgccgaggcggtcgtccgggagcgggccgcgggtcacgggcgcggagcccgccgtgtgccaggccgcctgcaccacgcgtcggcccggatcgcgcagcgccgtctccagcagaacgagcccaccggaggtcagccgctcgcccacgatgcgtggtacgggctccgcctgtacggcgacgtcgagccgtacgggtccttcggggccgtcggtcgtgcagccgatccggaagccgcgccgccgctgggcgtcggggcgggcccgctgcggcacacaggcggccggatccgggaacgccgcacccagttcggccccgccggcgagccgcgcgagcgcctcgtacgcctggagggcgcgcgacttcccgcacccgctggggccggtgaagagcgtcagcggtcccagtgggaagccggcccgccggtgcccggcgaaggcggacaggcgcagctccgagacgtgcggccggtcgggacgcggcccggcgtcgacgacggcgccggacgccggggacgacagggagggctcgaacgagaggggtgccgggagcgacccggtcgacagggatgacacggtcatatgcggaccgtagggggccgctgtcgggcgaaccgttccgccgccgcgaccttcctacgatcgagcgaccggcaccgctgacggccgtccgcccggggtgctcagatcccgggcacccccaccccctccatcagcccctgaacctcggttcccggcggcgtgagcaggaacacattccggtcgacccggtgcattccgctcgcgaggccgaagaccacgcccgtgctgaagtccagcacccgcttggcgacctcggtctccgcgctcgtcaggtcgaggaggaccgggatcccgcgcatcagcgtctcggcgacgtcacgggcgtccgcgaagatgttgacccgcaggaccacgaagcggcgtcgcgcctctgtctgcgcctcgggtatcgaccggtgaccgaccgcggacggccaggcgtcccggccacgcaagggaacgacctgggcgagcccttcccactgctcgtcggtgacatcgtggctgttcaccggccctccccgcactggctcgcactcattgtctgcaccggccaattcttactcatggtcacctgttcggcccaacagcgacacggtccgcgagcgtcccgacggtcacatcggccggatggcacccctccaccaccaccctgggctccccttccgccggggcctcacagtgcccgtccggcggctgtgcagcgggtgtaacccttcaagatcaggccgcgacacatccgcgtaacgggcaattcgtaccgtcgtcggcatgaccacgaccccagaggcggagcggacccggaccgcggagcaggtgcggaccgtctgctcgtactgcggtgtgggctgcggaatcgtgctcgacgtggggaccggccccgacggccgtcgtacggtcctcaaggcgtccggcgacaaggagcaccccgccaaccgcggccggctgtgcaccaagggcgcgacgaccgccgacatgctcgccgcgcccggccggctgaccagcgcgctcgtccgcgacgaccgtggcgcggagccggtgcccgcgccggtggacgaggcggtccgcgagaccgcccgccggctgcgcgcgatcgtcgacgagcacggtccggacgccgtcgccttctatgtctcggggcagatgagcctggaggcgcagtacctggcgaacaagctcgccaagggcttcgtacggacgaaccagatcgagtcgaactcacggctgtgcatggcgagcgcgggcaccggctacaagctgtcgctgggcgccgacgggccgccggggtcgtacgacgacctcgacaaggcggacgtcttcctggtcatcggctccaacatggccgactgccaccccatcctcttcctgcggctgctggagcgggtgaaggccggcgccaagctgatcgtggtcgatccgcggcggaccgccacggcggccaaggcggatctgtttcttcaggtcaggcccggcaccgatctcgccctgctcaacgggctgctgcacctgctgtacgagaacgggcacacggacgccgagttcatcgcccggcacaccgagggctgggaggcgatgccggacttcctcgccgactatccccccgccaccgtctccgagatcaccgggatccccgaggacgacatccgggcggcggcgcggctgatcggcgaggccggggagtggacgagctgctggaccatggggctcaaccagtccacgcacggcacctggaacaccaacgccctggtcaatctgcatctcgcgacgggcgcgatctgccgtccgggcagcggtcccctctcactgaccgggcagcccaacgccatgggcggccgcgagatggggtacatgggtcccgggctgccgggccagcggtccgtgctcgtcgacgaggagcgggcgttcgtcgaggagttgtgggagctcgcgcccggcacgatccgcgcggacggggtcgggcggggcaccgtcgagatgttccggaagatggcggacggggacatcaaggcgtgctggatcatctgcaccaatcccgtcgcctcggtggcgaaccggaagacggtcatcgagggcctcgaggccgccgaattcgtggtcacccaggacgtgttcgccgacaccgagaccaacgcgtacgccgatgtcgtgctgccgggcgcgctgtggacggagagcccgggcgtcctcgtcaacagcgagcgcgtcctcacgctggcccggcccgtggtcgaaccgccgggggaggcgacggccgactggcggctgatcgcggccgtggcgcgcgagatggggtacacggaggggttcgcgtacgagagtgccgagcaggtcttcgaggagatcaagcgggcgtggaacccgaagaccgggtgggatctgcggggggtcacgtacgagcggctgcggtcgacgcccgtgcagtggccggcggcgcgggcggacgggccggcgcggaacccggtccggtacgtggcggacgggctggtgttccccacggcgagcgggcgggccgtcttccacgcccggccgcatcttccggccgccgaactgccggacgacgacttccccttcgtactcaacacggggcgggtgcagcaccagtggcacacgctgacgaagaccgggaaggtcgccaagctcaacaagctgaaccccggaccgttcgtggaggtgcatccgcgggacgcggccgccctcggggtcgtggacggtgactcggtggaggtcgcctcccggcgggggcgggccgtcctgcccgccgtcgtgacggaccgggtccagcccgggtgctgcttcgcccccttccactggaacgatctcttcggggagtacctgagcatcaacgcggtcaccagtgacgcggtcgatccgctgtcgttccagccggagttcaaggtgtgcgcggtggcactggcccgggtcgcctcgcccccttcggcccttcccgtccggtccctcgatgctgcgccccctgcccccgacggcggcctgacggcctcgtccgctcccgccggacaggcggagatcttcggtctcacccccggcccgccaccggtgctgaccgcgcgggaacgccagtacctgaccggcttcctcgccgggctcggctccggcgcgccgggcgtgcccgtgctgcccgcggaagcacccttcagcgccgagcacgcgctctgggtcaacggcgtcctcgccgggatgtactccagggccgccaccgctgaggccccggcgaaaccgcccggccgcgaggtcgtcgtcctgtgggcgtcgcagaccgggaacgcggaggagttcgccgccgcgaccgccgagcggctcaccgcgaccggtcaccgggccaccctcgtcggcatggacgacacggatgtcgcccaactcccgcgcactgctgacctgttgctgatcacgagcaccttcggcgacggcgacgcacccgacaacggctccggcttctgggacgcgctgtccgcggaggccgccccgcggctggacggcgtgcgctacgccgtcctcgccttcggcgactcctcgtacgacgacttctgcgggcacggacgccgactggacacccggctggacgagctgggcgcggtgcggctcgcgccgcgcacggactgcgagccggactacgagccgtacgcgggagcctggctcgaccaggttctcggcgcgctgggcaccaagacggacgccccgaagcctgcccggccccgcaagccggaacccgccatcgcccgtctcaccggcaaccggctgctgagcctgcccggcgcgggcaaggaggtccgcaggttcaccttcgacacgagcgggacgggactgacgtacgaggccggggacgcgctcggcgtacggccggtcaactcccctgatctggtggacgagtggctgtcggtgaccgggctcgaccactccactcccgtggccgtcgagggagtcggcgaggtgcccttcgcccaggccctgcaccgccatctcgacatcacccacatcacccccgacctgctccggttcgtgtccgaacacgcccacgacaaccgggagttgaagaagctgctgcgtccggacaacaaggacggcctggcgcagtggtcctggggccggcaggccgtggacgtggtggccgagcatccggtgcgggcgacggccgaggagtgggcggaggtcttcaagcgcctccagccccggctgtactccatatcgtcgagtccgctcgtggacccgcatctggtgtccctgaccgtctccgtcgtgcggtacgaggaccggctcgggcggccgcgcggcggggtctgttcgccgttcctcgccgacgcggagcaccacacaccggtgccggtcttcgtgcagcgctcgccgcacttccggccccctgcggacagctcgacgccgatggtgatggtgggccccggcaccggcgtcgcgccgttcatgggcttcctccaggagcggcgggcgctcgggcaccgggccccgaactggctgttcttcggcgagcagcaccgcgccaccgacttctactacgaggaggagctgacggcgctgctggcggacggcaccctcacccgcctcgacaccgcgttctcccgtgaccagcgcgccaaggtctacgtccaggaccggatccgcgaacacggccccgagctgtggcactggctccagaacggcgcccggttctacgtctgcggggacgcctcccgcatggcgaaggacgtcgaccgggccctgcgggacatcgccgtcacccacggcggtctgaccgaggcggaggccacggcgtacgtgaagcagctggccgcggagaagaggtacgtccgagacgtgtactgagcccctccgggctctgatcctccattcggttccgatcctccattcggtgccttcttaccggcctcgcaccggactcttcacgtcatggcccgcatcgttcacgatgtcccattacgttccgtgtcgtgcacttggcagaagcagggccgtcgacaagcggccgacgggcgggtacgccggcggcgccggacgaggcaccggcacagtggcaccgggtgctgacgctcctcgcgtgcatcagcctgttcatcggcacgcggcaggtgtgggtgcaggccgccagtctccgtccggtggtggccgcggtcatctccctgtgctacgcggggatcctgacgaccggcctgctgaccctggtggtgcgccgcggccgcgcgctggcgcgcctcgatctgggcgtcctggtgatcgcggtgacgctcaccctgtgcgcctgggtcatgaaccacggcggcaccgacgaggccgtcctgaccatgcaggccgcccgcgagttcatcgccggccgcccggtgtacgaacagccgtggccctggctgttcggccacggcatcgcgctcacgccgaccatgagcggcggctacgacttcacgtacggctatccgccgctctgtctgctgctgaccgcggcgctcctgtggatcgggggcaccggcgcggccgcggccaccctggtgagcacggtggccctgctggccggcacggtcgttctgtggtggctgctgcccgtgcggtggcgctcggcggccaccctggtgtgcctcggcttcgggcttgtgccgtcgtacgcccggtacgggtaccccgccgtcgtcgcgctcgccctcctcatcccggtggtggtgcgctggccacggatgggcgggggcggctggacggactgggggcgggccgcctgtctgggcgcggcctgcgcggcgcagcagctgccgtggttcctgacgccgttcctgctggccggggtctacgcgctgcgccgcggggagcggggcccgcgcgccgccgtggtcgccgtgggccggatcggggccgtggccgccgggacctggctgctgatcaacgcgttcttcgtcgtcagtgagccgcgctcctggctctccggcatcatgctgccgctcacccagggtgcggtgatccacggtcaggggctggtcggggcctcgctctactacaccgacggcagcgggcgactggcctggtactcccatgcgagcacgctgctggcggcggtcctgctcgcgctgctcgtcctgttcatgcgccggctggggccggcggcgacggtgctgccctggtgcacgttcttcctggcgacccgctcgcaggacggctactacctgctgatgacgccgttgtggctggcggccgccgtcaccgcgccgccctcggccttcgcgagcgcctggcagccccggctgccgttcggggcgcaccggcggcgggcggcccgcgtgggcgtcgtcgcgctgctgctggcactgcccctgtcggcggcggcgtacgcggtgaccggcgcgccgcccctgcgcatggaggtcctggccgtccgccggggcacggggaccgtcaccgggctcaccctccgggtcaccaacaccggcggcaccaccatgcgcccccacttcacggtgaccaccaatcagggcatgaaccgctactggtcggtcaaggccggcccggcgtctgtccccgcccacggctcggcccgctatgaactcctgccgcccgacggcaggttcaagctccccgagccaggtgtacgcatccggctgcgcgccttctccgcgtcgccggagacgctgtcgagcacggatgtgcggttgcagccgaagcgttgacggggccctcaggtcacctgctccagcagcttcagcaccaccgggtcgatcacccggtaccgcacgacccgccccgccttctcgcccacgaccacctcggcggtgcgcagcagccgcagcgcctgcgagacggcggggtcgttcatgccggtggcgaccgcgaggtcggagacggcgagcggtccggcccggtgcagggcgaggaggagggcgagccggccggggtcggcgagcagggagaaccggtcggcccaggcgcgtacgccgtggggctcgccgatcgcggcgatggcgtcacagacccggtggccgtcgatggtgctccggtcaacgcggtcggcggggacgagatgcatgcgcgcattcttccaggcggccgtatgtgatctttcctacgtacggacacctgcgcaactgtgcagccttgcaggtgttcccaggtcagccctagggttggcgggccgtggtgctcgggaagccggtgacggcccctcagggggttcatgccggagcggccctcgccactgtgatcggggagttcccgttccgtgccgccgcgggcggcgccactggtccctcagggccgggaaggcagggacgggcgcgtgtacccgtaagccaggagaccggccacggcatctcacgaagtgatccacgaggtgctggagcgtgaccgtatgaccctgcccgcgcagtcttccgaggccgccgcctccttccggtggcggcgtgaggacaccgtccgtaccgccgggctgctggcggtgatcgcggccctgcacgtggtcgcgttcggcgttctgttcctgctggtcgtgcccgggcactacgaggtcggctccaaggccttcggtatcggcctcggcgtcaccgcctacacgctcggtatgcggcacgccttcgacgccgaccacatcgccgccatcgacaacaccacccgcaagctgatggccgacggcaagcggccggtgtcggtggggttctggttcgcgctcgggcactccagcgtggtcgtcgtcctcgccgcgctgatcgccgggggcacccagctggcgggacgggtcatgaacgaggactccaccacgcaccaggtgctgggcgttctgggtacgaccatctccgggtcgttcctctatctgatcgccgccctcaatctcgtcgccctcgtcggcatcctgcgggtcttccgggccatgcgggcgggaacgtacgacgagcgggagctcgaacagcacctggactcgcgggggttcatgaaccgcatcctggggcgcttcaccaagtcgatcacccgtcccgggcagatgttcccgttgggcttcctcttcgggctgggcttcgacacggccaccgaggtcacgctgatggtgatggcgggcagcggtgcggcggccgggctgccctggtacgcgatcctgtgtctgccgctgctgttcgcggcgggcatgagcctgttcgacacgctcgacggcacgttcatgaacttcgcctaccagtgggccttctcgaaccccgtgcgcaaggtgttctacaacctggcgatcaccggtctgtcgatcgccgtggcgtttctgatcggcaccatcgagctggtcggcgtactgcacgacaagctcgacctgcgggactcggtgaccggctggatcgccggcctcgacctcgacaacgtgggctacatcatcgtcgggctgttcggggtcgtgtgggcggcggcgatcacgtactggcgggtggccagggtggagcagcgctgggcggtccgccccgccgacgggaactgacgccggcggggggggcgggccggcggctactcgtccacggagcgggcggtggcggtacggccgcgggcgatggcgaagcccgcggcggccaggccgaggacgccgacgatcagtccggcgatgccgagcccgcgggcggtcgagtcgctgtcggccgccttggtctcggaactcccgctcccggcggcgctcttgtcgctgtcggcggcggacccggtgtcctccgcggcgcccttggcggtgagccggagcaccggcgccgggttctccggctcctcgccgcccttcggcgtctcctcgatccagcgggcgacgtttccgtcggagtaggtctgcagcgtcttgaaggtcagctggtcggcgtcgtcggggagctggccgaaggcgacatcgaagtcctggtactggccgtgccggatgcggccgccggtccaggtgatctcggagacggcgtcggtgatggtgccgtcgtccgtcttgaccggcgtcttgagcttcgtggtcgtcaccttggcactccagccgtcctgcggggtgacgagcacgcccaggaccgggtggtcggtgggcaggaagacctgcaccttggtggtgcttgcggtgtcctcctcgttgggaacccggaaggtcacaacgccgtccgtggcgcccttcgcggagctctcggagtggacggtgacgtgcgcgaaggaggcgcccgccgcggtgaggacaccggcggcggcgagagcggtgacggtgccggcgcggcgcagggtggtgcggatcggggtggtgcggatcggggacatgagtggggaaactccgtactcgtgctggggtgtaggggatcaggcggggtacgggcttccggcgggcgggccgcgccgggacagggcgtggcggagcagggtccggtgggggcggcgggggccgggcgcgtacgggcgtgccgcggccgcgtacgcgggcagcggtgccgtacgccaccaggccgcgaggcccgggacgaacgcgacggccttgcgcagcagcgaccacagggcggcctcgccgcggcgcaggcaccaggacgcgagcagggcggcggcgaggtgtgcggcgacggcgtgggaggtcatcgcgtgcggctggtgggccatgtgcatgccgtgggccgtccccggcatgggcatccgctcggcccgtggccgcacggcgtcgaaggccaggtgcatgccgccctgcacggtgagcatcgcgccgccgatcccggccagcgaccgctcccggccgcccagcgcaaaggcggcggcgaagacgggcaggaacccggccacgtccagccacaccggcggcacggcaccggtcgccagcgcgtgtcccccgacggccagcagcacgcacccgacggcgaacaccgccgcgcgtacggtccggaccgtgggggatgcgttcatcgcggtggatcctgccatgcacacgggggtgacgtgcgggtttcacggcatccgtggtcctgatctcatgccggtccgccacggaccgggcggctcacgagagccacgacggggcggggaaaccctccacgaacggcaccacgggatcgtcggaggccgcgacgacccacgtgccggcgccgatggagacggtgggccggtcgccgtggccgggccggtgcgccgcgagccgtacgctcaggagttcgtcctccgcgggccggcgcaggcgcagcgcctcggccacggcgcggccccatgagttgccccgcaccaccaggactccttcgggacgcagcaccaccacggcctcccgtacgcgcctcttgtggtcctgcccgcggagcagggggcgcagcgcggtgacggggaccggcctgccctggacccggcggaagaactccgccgtacggccgaccgcgtccttcggggcgaggatcgccgcgcgggtcgcgtcgtcgaggtgcagcaggacgttctcgggcagcggggcgtcgcgacgcagccacagcacggcggaccgacgggcggaagtggtcagcacggccgtgccgtcgttctccggttccgacgtgcgggtgagcgcgtcgggccgtacccggatgagcccggccgaccagcgggaggcccggtcgtcggcctgcacgaccaggcagaggacgtcctgggtgtgcggggagaaacgccagttcggccccgtgagcgagagtcgcagttcgaacgggacgggggcgcggcgcccggacggacgccacaccaggtccgtgctctcgccggcgtcgaaggggaacgcgcggcacagggagcgttccagttcgagtgcggtcagcgcccgctcccgtcccctgagctgacgaaggtcgaagcggccggtgttctccatgtcgagcgccgcgtcgaagcagtcgcgcagggcgcctgccaggcgccgtccgtccgggtcgagttcgttgaacgtccgtgccagtcggagcagttcggagtcgtccgcgtaagcgtgcccgagcggggtgaggacgacgcacacctccgtgcccgccgcgctggtgaccaggtgcggggcgaaccgcagcagcgggcggccgtcagcggtgagtgccttgtacgcctcgggcgagatgcagagggtggggtgatccgggtagtggtccgacagcctgcggaactcggcggagcggagcatcgcccgggtgtactcgacgcccacgtcggacgtcaggtcgacggggtccgtctccagggggcctacgtgcacggccagtcggggcggagccagttcaccgacggcctccagttccgcggggagccggtccgccagctcggtgaggagggggccgagcgggaccgcttgatccacgaagatcaggcagctgtcgtgccatgtgcaggccgcgagctgttcgtccgcggtgacggccgtcccggagcggagggtgcgggtcaccgtgtcgaggatgcccacggccgaggtgtacggggaggtgtcgaccgcgatgaccgtccgggcggccgggcccgggtgcagtgagctgttcagcgcgttccgggcggcctcgcgggccgcctcgtggtccgatccttcgagcagcgcgagggccgcgcgggccgcctcctccgcctcggccgggcggcccaggcggagcagggtgtgcgcggtacgggcgagggcctgggcctcctcgtcgcgcaggtggcgggtgcggaagtgggcgcggacccggcgctgggcggtgaggagttcctcgtccgctccggtggcggagaacgcggattcgagacagaggagggcgttcccggtctcggcggtcagaccgaggtcctcgaagaaccgggcggcccgcacggcgggcgcgaccgcctgcaccggctcgtcgcgccgcaggaaggcccgggcgaggacgagggacgcggtcgcctcgccgtgccggtccgcgtcctcgtggaagaggaggcaggccagccgcagttccccgacggcccggtccagcagtccgcgcgccagcgtcagccgcccgaggagcagggcgttggtgccactcaacgggccctgccagcgggcgacttcgggccaggacagggcttcgacggtgtgccacgcgtcgtccggccggcccccctcgtactgggcgtgcgccagcgcggccacgccccaggcgcccgggacgaagtccgaggtcctttccaggaacgtgtgcgccgcctgctcgtacagcgtccggtacggcgtcgtggctcccgcgtcctggaggaggaacagcacccaggccccgagcgcggagcgaccggtccggtcgaggagcgccagcgcgttggggatccagccttccgggaggcggaccggcagcgggggcgcgtccagacgcctcgcgagcgccgtgccggggcgcctgttctcgtacatcgtggcggccgcggagcggtagaagtccaggagccgtgcggcggcctcgccgcgctccacggcgtacgccgtgcgcccgtgcaggtggtcgtggacggccccgtggaatccgtacgcgtcgggcccccggcgctccagcagtccctcgtcgaccagggtgtcgaggagccggcgggcgtccgggaccgggcccatcagtgccagggcctccgggaaggagaactcgccggtctccgccacggccagctgatgcagggccgtcgcggacgcccacggcaggtggtcgagacggagccggagaaacccctccaggctcaggggctgttccccggccccgtagaggaggtaggcgagttccggcgggttcgcggagttgagccagctgcccagcagccgcacggtgaggggccaccaggtggtcccggagagaagcgggcgcagcaggtcgtcgtcgcggatcgtgcggcggagggtggcttcgagcagggtcagcgcgccgtccgccgagagcgagtccagccagacctcggaacagtgcgccggcagaccgggcggcaggccgcgcgcggtgacgatgacggcgcagccttcgggcggttcgcccgcgaaacagcgcagcagttcgggggtgctcgcgtcgtccaccacgaggagcacccgtttcccgcgcagcgccgagtggagcgcggccgcgatgtcgtcgggctcgcgcgggatcccctccgcgggtgtgccgaggagccggagcagcaggtgcagtgcggcgtcgggcggcagggggacccggcgggacccgcgcagatccacgtggaactgcccgtccgggaagtgctcgcgcaccagccgggcgacctggagggcgagcgccgtccgcccggcccccggggcctcgttccgcgcggtcacgaggaccacccggctccggccggaggcgatctgtgcccgcatttcctcggcgaccgcgttgtactcgacgaacaccggtggggcagggggaagtccgtccgcccccgacacccacttctcccccgtctccgccagccccagcagctccagcgtccgccgggaagcctccgcgaacgcctcccgctccccgcgcagttcgcgcgctccctccgggtcgtaggccgccgcggacagcagcgcccggccgtccccgcgggacgccacgtgccgggagatcgcccggtggatcccccacacctcgtgtgcgcccaactgttcctggagcacggtctgggcctcggccggcagcacgagttccaccggacccgtgccgtccccctccagcgcgaacaccccgctcgtcaccacctccgccacgtccgcggtcgtggcctcgggtacgagttcctgccggatgacgtgcagcaggcgcaggctcaggcggtcgaacggcgagcagagcacggccagccgggccgcgcgcggcgccgccgtgcgcaggaagcccttggcgagtgtgtccggcggcagcggaaccccgcgcggccgggcgggacccggcaggcgtccggtcggcgggacgagtaccgccgtgcagccgtccgggtcgccccgcatcagcgcccgggaccagcggcccagggagtgcggggtgagcgagaggaccgggatgggcagccaggggtcttcgtccggatccggcgacacgtccagcaggggtggtggctcgtgcgggacccggctgcgcgtcgcgcccggcgccgcgggggtgaaccgcacggtgggcaggttgaggccgccgcgccgccacagcttggccgggagggggttgagcaccgccgtgggggtcgcgcccgcccagtccctcagcagatgccacacctccgggcggcgccaggccttcgccgtgcagtccgagaccaccacgaccaggcggcggccgtccgtcgagcggagctgaccgggagtgtgcggacgctgggcggtgtcgaaggtgaggtccgcgacctggagggtgcggaaggcgccgagccggtccaggaccgccgcgaactcggcgatcgtctcccgccacacctgcatgccgggtgagcggtcgacgaccagcgcgaggtcgaaccaccgctccggcgccgccgtgaacaccgggagcagttcgccgctgcgggcgtagccgtcgacggtggcgtccatgtccagttgggcgcggcgcccttcggaccacggccgtttccacggtcgtagcgcccgggtcagctccagggcgtgcggcagtaccgccgcgcggggtgcggccaccggatgtccgcgcagggtcgttccgctgcccggcagccgttcgtgcagggggagggcgggcgaggcggccggggcggggtccgtggcgtccggggcccgtgtgccgtcgtcgtccgggacggggaacggctgccggggcccgggcgccgacggccgctgtgcgcggccctcggtctcgggtgtgccggtcgccgtccgtgcgggcgcgtcgaccgccgggtcctggtcccgtgccatccgcgccgccagccacagcgcctccgccagcgccgtgccgtcgaggccggggacggcaccgtgcagcgcggacagcagtcggggcagcgcgtcaccggaaccaccggagtcctcgccggagttctcgaagtcaccggacatgtcggaggtacccgtcgcggcggacccgggcgtcacgcatgggacagttcccgcagaatcagttccgcgatggcctggcggcggtcgtcaccgggcgcgccgtcgccggtcagcaggtgtacggcgttgaggagctggtccacggcgaggctctcgccggcggtcagccgttccaggaacacggtgatcagccgtccggtctcgtccgccgccgccttctcgggccccatgtgcgcctcgacgacccgcagcagggtttcgggggtgggcagcggcatcgtgaagcggatgcagcggcgcaggaaggcggcggggaagtcgcggtcgccgttgctggtcatcacgatgaacgggaactcggcgcactgcacccggccgcgggcgatgaggtgcgtccgctcgccgccgtgttcgcggacggggaccacgtccgtgccgtacctggccagttcggggatctcgaactcgccgcgctccagtacgtcgaggaggtcgctgggcaggtccaggtcgctcttgtcgatctcgtcgatgagcagggcccgggggcgggcggaaggcagcagggcggtgccgagcgggcccatgcgcaggaagggggcgatgtcgtcgctgccgccggggccctccaggcgctgggcgtggatgcggccgagtgcgtcgtaccggtagagcgcctcggcgaggctgctgcgggaggtgatgtgccagcgcaggacgtcaccgagtgcgagctcggcggccacctgttcgatgaccgtggacttcccggagccggccgggccggtgaccaggagggggcggcgcagggcgagtgccgcgttcacggcctcggccaggcggggcggcggcacgaactgccggtgctgggagcggcgcgggaactcccgccagggcggggcggggggcaggacgacctgctcctcggcaccggccggggcctgtccggtcccgacgtagaagggctgccaggtcatgtcggatactccccgtcggtggtggcgctttcttcctgtgctgcttcgtgggtgaactgctcctgctcgaaccaggtgcagaactcgagccactcggggccgtcccacaccgtgcgcagcccggccagccgccgtcggtcggaggcggccgcggaggtggcgcctgccgggtcgccgcacgtgctccacttgtcgcggtaggcgcggcagaactccgcgggcagcagatgccagtgggtgtccaggtaggcgcgtacgtcgtccggcaccgaggcttcgtcgtcgggccacagcacgatgggcgaggcggccagcagccgttccatcatgtccttgagccgggacggccggtgcgtcagggccacggcccgggtgcgcggcccgctcatcagccggccgtaggtctcctggaactgccgggtgtccgactcgccgagccagtcggcgcgggtgccgtccgggcaggcccgcatcgcctccagggccttgcgggcgcggtcgttgatccaccagaggtggtcgggcggctggatacggtcgctccagcgcaggaccacgtcgtgatcggcgccgagccgcatcccgaagtcggtctcctcggggcgccactggaccagcagcggggcgggcgcggcgatctccacccggtacaggggcgcgcccaggacgcgcgcgtgccgcgacgcccagcgcaggacggtgccgagccggccctcgacgccggtccggtccgggtcgcaggggaactcctcgtggtggcgtacggcgtccccgtcgagcagccaggccgccagcgactcgggccagtcgtcgccgaccgcggagtgcaggctgacgacgagtcgcaggcgcgtgtcgcgggtgcggtccgcctgtcgtacgaaggcgtcgttgaggtcgatctcggcgtccaggtcggcggcccagcggcgcagttcgggggtccccgggtcgacgcccgtgtcccgggcgagcgcggccacgaagtccgccagggggacggtccgtcgctgaccggcccgtgggctgcgcagcagcaggtgttccacggcgtcgcgcaggaggccggtgcccctggactcgggcagggtcgcggtggacgcggggctcacctcggcgagggtgcggcgcagcagcggggtggtgaggtcggcaccgggccaggcggtcagcagggcggtggtgcgcacggcgtcgcgcagcgcgtccagcacaccgagcgcccaggcgcgttcggcggaggacgggagggcggacagcgcgggcttcagcgagtccaggtcccgcaggccggtgactttggccggatgggacaccccggacgagtccgggtcgccgcccagccgttccagggccctggccagttcctcggcgcccacgggtccgagcaggggacccgtgggagtgctgtgacgggcgttgcgggccagccacaaccgctcctgggcgagttgggcgccgtcgaattccgtacggaggatggcctggccctccgcgccgccgtcggtccggacggcgtccgcgacggccgccggggagagggtctcgccggccccctcgatgccttcgccgcacaccttcaccagggtccggctgaagcggagttcgtacgcctcctccttggcgccggctcccatgagcagggcgagccgggtgtcgccctccctgatgccgccggccagggacttgaggtcgggggcggcgttgcccgcgtagcaggtgtccacgagggcgatcacgccgtcgaggccgggggtgtccagcagttgcgacagcagcgatccgacgtcgaccatcttcgtggggttctcgggctccgagtcgccggccgcgaagtacaggctggttccgccgggcgtgccgtggccgagcagcgccacgaccaggaccgcgccctccgccgccgcgtgccgtcccgcctcacgtacggcccgctccacctcggcctgggtgacgtcggcgccgcagcgcagggtcgtccgctcggggtggtccttctcgcaggcgcctgcccagggggccgtcagggtgtcgtgcagggacctggccgcctgttcgagctccgggagcaggccgagggcggggcactgggccccgatcaccagtacgtggcgcggcccgctcatcggccgccggcggtggtgagggcctcgacgagcggtcccgcgacggccggttgtgccaggtacttggcggccgggtgcacccacgcaccgtccgagtcgacccggccgctgaccgggagagcgcccgcggcgttgggccggacgaacttctccagtgcgggccgggcggcgacgagatcgtcgcggtcccagaaattgagccaccggccgacgcactccggggtaccgagcggctgcggccgtacccgcggctgtacggccgtacggatgccgaggggtgagcccagggtgatcagcaggggtacggaagcacggtgtgcgtggagcgtctcgagggcgacgaccgtgcccagggagtgggcgacgacgaccgtgggcccctcccggtccaggcactcggcgacccgggagcggatccggtcgtcgagtgcggcgccccgctcgtccggctcggcgcggttgaggtagcgggcgacctggcccagcatgcccgccgtggtgcgggcggtcagccagccgcccgtggcgcgcaggcccggtagggccagcaggctggtcagcgcgttgaccgcgtggcgggccggggcgccggccccctgggcccggccggtgggcgcgagctgggctctggcccggcgcagtgccgcggcctccgccggggtcagttccgggtcggtgagccgctcgtcgacggcctcctggagcagggcgacgagcgcgtcctcgtcctgtgcccccgcggccgggccgccctgggcgccgctccttcggaacaggtcgccgtagtaggcgaagcgggcgtcggccgcccagccgccgaggaggccggagatccgcgcggagtgcccggcggcacgcgcgccgtgggccgtggcgcgcagccactcgtccaggtcggcccgggcgtcccgcggaccgccgatgccgtggacgaacaccagtcgaggacgacccatcgctttcccgctcccccgattcggcgcacatggattcggcacatatgcaggacagagatcctttcgcgatcggtggagcaccggcaaccgctgtggaactctttcctgcacctacgtcaggaaccggcgcagaatggccgaaacgcaacgccgggcctgccggtatcggccgttaccgatcggaacccgtcagccaccgcggtcacttccggttccgcacccggttctggtggcgatcgcgccgtgctgtggggccggtgcgggtcaggtgtggggttccggctccgacgcgccaccggaccccgttccggtggcggcctggcgggcgcctatcttggcgctcatgcagtcctacacaatcggccaggccgcccggctgctgggcgtgagcccggacaccgcacgacgctgggcggacgccggccggatggcgacccatcgcgacgagggcgggcgacggctcatcgacgggcgggacctggccgccttctcggtcgagatcgccaagtccggcggtgaggaggacgcctcctacacgtccgtacgcaacgcctttccgggcatcgtcaccgccgtgaagctcggtgacgtggccgcccaggtggagatccaggcggggccgcaccggctggtctcgctgctgacccgggaggccgtggaggaactgggtctggaggtcggcgtggaggccaccgcccgggtgaagtcgacgaacgtgcacatcgaccgggcctgaacggggcccgtacgggcggcggcccggccggtcggacccagcgcgccaccctcgcccgcgccctggccactcaccccggctgctgctgcgcgacgagccgctcgtcgcgctggacgcccgcaaccacgcggacgcacgcgtaacccggcctgaggggccggccgggctacggtgaggcccataacggctgaagcgtgacaaacccccactccttgcgaggccctccccatgagcctgagtatccgcaaccagctccccggcaccgtcaccgccgtcacccggggcgaggcgatggcgaccgtcaaggtccgtctggacggcggccaggacatcaccgcggcgatcacggcggacgccgtcaccgacctcggcctgaccacgggtgccgccgtacgcgccctggtcaagtccaccgaggtctcgctcgccaccgacgcggtcgagggcgtgtccatccgcaaccagctgcccggcacggtcgagggggtcgccgcgggcggcgccatggcctccgtccgggtgacggtcgagggcggcgaactgaccgccgccatcaccaaggaggccgtcaccgatctgggcctggcgcccggttccgccgtcgtcgctctgatcaagtcgacggagatcgccctggaagcggtctgaggatctccgggatctccgtggcgacgccccaggtcttccccggctacggcccggggaactgtgcgcactccaccatcgtctacagttccgtagacggtctacatatctgtagtcggtaggggtgcaccgtcacgccctgtcgtccccaagcggaagggctcgcgacgatgaccccacctgttcacctggctgcgcagctcgcggtcaacgtgctggacgcccagtccctcctggccgccttcggcgtgctgggtgtcggcgtggtgctgttcgccgagaccgggctgctcgtcggcttcttcctgcccggtgactctctgctgttcaccgcgggcctgctgtgcaccgggacggcggaccacggggtgaagctgtcgctcgggccgctgctggtcgccgccgccgtgggcgcgctcgccggctcgcaggtcggctacctgctgggccgcaaggcgggcggcgccctgctcgcccgcagccgctcggcccggctgcacgagggggcgaagcgggccgaagagctgctggagcggtacggacacgcgaaggcgatcgtgctggcccggttcgtgccggtcgtgcggacggtgctcaatccgatggcgggagcactggacgtgccggtccggacgttcaccctgtggcaggtcgtcggcggcctcgtctggagcgtgggcctgaccctggccggatacgcgctgggctcgtccatcccgaacgtggaccgttatctgctgcccatggtcgcggtgatcgtggccgtgtcgctgatcccgctcgccgccgaggttctccgctcccgcagggcggccagggcgaagggagcgcgtggatgaacctcggggagtaaccgcccgccgtgtcacagcgtcttgcggcggaccagcagtccgaggacgaacaggccggggagcaagggcagccagaccgtcaggaggcggtagccgagaaccgcggaggccgccgtggcggcgggggatccggcgagggtgagggccagggcgagcgcggcgtccagggagccgattccgccgggggtcgggagcagggcggcggcgccgctcgccgcgaggtacgccagcgccaccagggccggcgacagcggtagttcgagggactgggtgacggccaccacgaccgaggcgtgcagcagggcgaaggccagcgatccgccccacagggccgccgcccgggccggctgccggtgcacggcgcggacgtccgccagcaccgcccgtatggcccgccgcagcggcccggacagcagcgccgcgatcgccgcgcccaccgcgaggacgatcgccaccgcgaccgcgggcacgtgcacgaccgcggggacgtgcgggacgcgcagcacgccgggacaggcgagggcgagtacggcgatcaggacgccgcgcaccacggccccggcgacggtcttgaccgcgagcgccgtcgccgagcgggccaccggcagtccgcagcgggtcaggaaccgcaggttgaccgcgcccgcgccgatgcccgcgggcaggacgtggttggcggcggacgcggcgaactgcaccgccaccagccgcccgccgggcagcggctgcgccaccgcaccctgctgggcgagcgccgacgacacccacgtcgacaccgccgccgtcgcgcccaccagcagccagccccggtcggcggcggcgagccggtcggcgccggcctcgatgacgggccagtggtcatgggcgagaaagacggcgccgacgaggacgagcagcgcggcagccgcgtgccagcgggagcgggtccgtgcgcgctcgggcggctccagcgcgtcgggggcgtcgggggcgtcgggcgcgtcgggcgcgtcgggggcgccgggggcgccgggggcgccgggcgcgtcgggggcgtcgggcgcgtcgggggcgtcgggggcgtcgggggcgtcgggggcgtcgggggcgtcgggggcgtcgggggcgtcgggggcgtcgggggcggacgtactcgatgtggtcgatgtactcgatgtgccggacgggctcgatgcgccggacgggctcgatgtgccggacgggctcgatgtgccggacggggtcgacgcggtggatgcgctgcatgcactggacgcgctcgacgggtccggtgtgccgggtgtgctcgacccgcccggcccgcccggcccgcccggcccgcccggcctgcccgaccgcctcggcatacgcgtcatccgcgtccgccctcccccgccgccggtgccacgtggatgcgtacggcgccgtaccggtgggagggccagtcgcgggcgtaggccggtggcgagccgttcgccggggcgagcgcggcgaccgggatccgcgtggcggtccgcaggatgcccgcccgggtggcgttggcgttgtggccgctggtctgggcggaggagcagcccgtgtagaaggcgatcgggatggcctcgctgccggtcagcaggcacggtggccgtacgccgagacggtgcagttcgccggcggtgcgggcccagccgcggtgggcggcggtggtgcggtcgaccgccttctcgagcaccgcgtactgcaccgccagatgcccggcgaggacgagcgtcaccagcgccacggccaccggccgccacgcgcggcgcggcacgctgaccaggtggacgagcgcgtcggcgaccgggatcgcgagcagcgcgtaggcgggcagcagaaagcggggcgcggcgtacccgatcaggaacaggtacgggacggcggccgtcgtcgcgcaggccagcgggaccagggtggccgccgtgcgccgggcccggaccgcgacggccagtccgagggcggcgagcagcggcaacacgaaccaccacgccatcacggcgacgcccggcatcgccccggtgcacggacggcacagggcccgcccgccgaggctgcgcagctggtcgccgacggcgatgttccagccgaggccgccctggatgtgggaggcgtcggacagccgctgccccagtccgccgtaactggcatacgcctcgacgacccactcgccggccccggccaccagcccgaccgccagagccgtcagcagcgcggggcgccgccggccccgtacacacgccaggagggcgagcagcggcagggccgtccagatcgcgtcggtgggccgcatccacgccatgagcgccgcgccggctccgactccaccgagggccgcccggtcatagcggtccgccggcgcgtagcggtccgcccggccgtagcggtccgcccggccatagcggtccgcccgcacgcgcaggaagcagccgacgcagatcagcgcgccgatcgccacccagtagttgggcatcgcctgcgggccgtagaacaccgtcacccacaggctcgcgaagagcgcgcccgccagggcgagcacccgcgccgggaacaggccgcgccagacgcgcagcgccaggtacaggcccagtccggacagcagcgcgagatagacccgcagcagcggcgtcgacgacgaccacgaggtgatcggtgcgaccagcagggagacgccacgggcgcgcggcgcgctgaagaacgcgggcggggcctgcgcgctgatctggctgacgtacacggtctcgtcccagccgagccccatcccgggtcgtacgagggcgagttgggccagggtgaagagggccgccagcgccgcgagcgccagttccccccgcccccgccacgaggtgccgacgaccgccggtggcccggggcggcgaccgccgacgagcgtgacgttcgagctgttggccatcgtccacccctcacctcctacgagttgccggattcccctgaccctgcgagccgtagggctacgcccagaaaccgcaacaaaagcgaagatcaggaaaaacatggacaagttaccgcgctccacccaggggtgcagcgcggaggtcgaggaggttcggccgcccggcggcctgttccccacccctggcgtacgtcccgccggggccatcgaccgcccgcgttacgacggacggcggatccgggatctccgcctcaccccggacaccgaatccggcggcaccgacgacggcgcctgcgacgggcctccgtgtccggggcggcgctccgcgcccctacgcgccgcaaggtggcggacatggctgaccgcgccccgtgaccctccggagacgcggggtccgtcaggcggcgtcgaggtcgtcggcgaagtggcggtacccgtggcggtcctggtgcaggccccacaggatgtccgccagcacggccgggtccttccgccggtgccccggaatgatcgcgccggggatgatcagctgcgcgacgtggatgccgtcgcccgcgagcgtgtcgtgcagcaagtggccgtacgcgctctccgcggcgaaggcgaccgaggtgccggcccggtcgggatgggggacgaccgccgtgccgccgttgacgaagaggacggtgccgcggccgagggcgcgcatcccgggcaccgcctgctgcacggcggcgacgggcccgtagagggagaactcgatcgggccgacgagatcggcgggcgtggtctccagcaccggccgcatgaactcccgctgcgggaccggactgtactgcaggacctcgatcgggccgagggtcgcggtcgccgcgtccagggcggcggtcaaggccttcgggtcgcgcacgtcggcggcgaagccccgcgccgtcaccccctcctcggccagctccgcggccagggcgtcgacccggccccggtcgcgcgagacgagcgcgacgtcgaagccctcacggccgaaccgccgcgcgaccgcagcaccgagaccgggacccgctccgacgatggcaatggtggtcatggcttctccttggacgttcaggccagtaccccggcggccagggcgacctcgacctccgcgctcgacctccgcgccgccgccttgctcgccgcagaagtcccgcatctcctggatctcacagatgccgccgctcagcgaaccggcggacgacctcggtcagcggcagcggccggggccgccgcgcgaccacggctggaaccaccccctgaccggcccttcggtaccgcttacctggtcggtaccgctgacctggccgccgcccccgccggtgggcgtcttccggatgcggcggtggggccgctgacggatggtggatgacgtctgccccatcgcggtggcgctcctcggtcaccgcgcgcacgacgggccggccgaggcgcgccacagacagggaaagggagctatgccatgagcgttggtctgccccgaaggaagagaccggtccgatgccgttcggccacggtcacccttgccggactcgtcgtggcagcggcgatgggcaccgcatcgctcgtgtcgtgcggtacggacggcggcggcagcggcagcaacaacgcgtcgttcagcccgacccccaccgcccccgacaccgcgtcgttctccggcaccccgccgtccgccctctcctcgctcggcgcgtccgtcaaggaatccgcccgggcggcggcctcggcagcggcctcgtccgcctcggccgccgcttcggccttcgaagcctcggtctcggccgacgtggcgcgggccaacgcggccgccgagcagcggctcaagaacgccaagggccagggcaacgcgatgtccgacgtcgcgctcaccggcaagccgcgctccgagacgggtggcgtgctcgccctcgtcgtgaacatcaccaacaggacggacaagaccgcctcgtacgccgtccaggtcgacttccgcgatcccgacggaaaggtcgtcgagacccgcttcgtcggcgcggagaaactcaagccgggtgagcgggcacagcccctcgccatcagccggaagcctcccgagcctcggctgaccgccgagatcgcgagggcacaacgctactgagcgcagggcacgacgtcattgctgaaccgagcggcaggcacggggcgcacccgcaccttcagcgtttcggcaggagggttccgagcggtccgaggtcgaggttgaggtcctccggacgcaccccgtgctgctcgcagagttccgtcatccgctggtcgagcagcatgagtgtggtcccgatctcgtcgacctgctcatcgctgagatcgccctggtcgatacggcgaatcgcctggcgctccatcaactgtctgaggagttcgaccaccgtcaggacgagggcgacgaggtcgcgtcccatctggtcggagtccaggtcgagccgggaaccggtcacagcgggcctccgtccgcccagggcgccggaacgcgttcgctgacggacgacagcagggcgtgcagcgacaaccgcacgagtggcacgtcggcaatggcgatgaccaggtcaccgctgatcaccacgccggtcgccaggacgcggtccaagaggtcgacgagcggcaccccgatggggccgctcaggggctcggggctgtcccagggcaccacgtcgcgtgtcacggcctacacctccccgacgaatgaatagggcacccacggccccgacagctcgatgtccgccccggtccgtttccggagcgtccgcgccaggagagcgaactcgtcggcgcggtgttctgccaccaggtaggtggcgttgaggatctggacccgccggtccccggcggcctggggcccgtgcggtcgcagcctgcgggacgcggtggcgaggccacggacctcggcgtccaccgcttccgcggtccgtagcgcctcgtcctgacgccgctcacggcgctcttgcaggccccgcttgcggtccaggtaggcgaggccggcgccgggcgcggggcgcgagcggtcagccggagtcgtacggcggttcggagtccggtccgtgtcgtttggcgggcaggccggcgcgtacaccttcacgccccactcggcgtggtgcgcgatgcgcccgagcgccgcgtggaaccggtccgcctcacgggccagggcctcccgcgccctttcctcaccgtggtagagcgtggccatcggcaggggaaccgtggggcagcaggcggcggccgcggcgacgacttcgtggtgggcgcgcgcgtatcgctccagttcccgctggtcggacaggcgtgcctgccaggcttcgtcggtgaagtcacccgctcggacgggctggacgatcgccgtcagggtcccgagcggcagtgtgcccacagccgcctcgtcggtgacacccggcaggccggcgacgacggccggatccgggttccggcagacagcgaacacgtaggtggccttggcgtccgaaggctcagggccgcgctccgtcatgtgcctcggtcctccttggccgccgctggggccgattcgtcgtccgtccgggattcgagcgccttcagacgctcccgcagttcacggttctcgtcctgtaacgcgctacgggccgcgcgggaactgagcgccggatcggtttcccaccagtcgatgccggccttcttcgcggtgtccacggacgccacgaacagacggagccggatggtgagcagctcgatgtcgaggaggtcgatcttgatatcacccgcgatcacgatccccttgtcgagaacgcgttcgaggatgtcggcaaggttggtggtccccgggccggagaccgggtaggccccctgccggaaatcgacgtcagccacggcctcgcctctgccgtctctgcttcctcgacggggctacgtcctcgtcctcctcgtcctcctcaccctcctcgtcctccaccgcgtcttcgtcctcgtcctcgtatgcgccttcctcgtcctccgccccctcctcgtcttcgtcctcgtactcgtccgcctcctccgcggcgccttcgccctcgtcctcgtcctcgtcctcgtattcgtagtcggcatcgtcctcggcctcgccctcggcctcgccctcgccctcctcctcgggctcctcgccctcggattcctcctgctcagcggcctcttcttcttccacggcgtcctcgtgggacacgacgacttcaccgtcacggatctcaccgcgccagccttcgggctcttcctgagtgagggagacgtaccgctggaaatgcttgaagtccagtcgcaggcggcgcccttgggcccgccacaggttgcccgtcttctcgaagaacccggacgggtagtactccacgaccaggacgatccgggtcagggtgggggccagctcatggaagctgaccgcaccacgggtggtgcccttggctccctctgaggtccagacgatgcggtcgtcggggatctgttcctggaccgtcgctttgtaactgcgtgaggaagggccgaccttgaccttccagttactcccgacctcatcggtcttcgagacgtcacgaacgcccttggcgaagctgctgaacttgtcgtactgcgtccagtggtcgtaggcggcgcgcagaggcactcccacatcgagaacctcgatgatgttcatgaccttgccgccgctggccttgcgtttcccttttcctccgcccagggcttccttggccttgcccagaacgttgtccttgaggcccttggccttctcgctgacgaatgccttcagcggggagtcgccctggaggatgcgggagccgatggcgggcaacccaccaccaccctcggccacatcggtgagctgccccgtgacgtcactcagtttgtcgcccgccttttcggcgagtttctccacctgtgcgccgaggaagttggacagctcttcgcgcagccggtccgcgcctgacgcttcctctgcgggctggtctctctccgtcttggtcatggctgactacctccgacgatcggcgcgcttggacgctgctcgcttcgacgacgtcgtcttcctggccgcggacttcttggccggagcggttttcttcgccgcggacttcttcgccgcggacttcttggcgggagccgtcttcttcgccgccgccttcttcgcggccgtcttaccaggcgcggacttcttggcgggagcggacttcttcgccgccgccttcttcgcggccgtcttaccaggcgcggacttcttggcgggagcggacttcttcgccgccgccttcttcgcggccgtcttaccaggcgcggacttcttggcgggagccgtcttcttggccgccgccttcttcgccggcgtcttctttgccggtgcagcctttcgcgccgcggccttcttggccgtccgaggcttctcttcacccgcgggagcggccttctcgcgtgcctctggtccccgtgccttgcgggaccgagccgattgccgagcgctgcggggtcgcctgggccgcgtctcctccggctccggctcctcttcttcctcttcctcttcctcttcctcttcctcttcttcctcgccctcgggctcttcctcctcttcctcctcctcttcctcctcctcgtattcgccttccggctgttcctcctcctcttcctcttcctcttcctcctcgtacgcggcctccggctcttcctcttcctcttccggctcttcctcttccggctcctcctcttcctcctcttcttcctcctcgccctccgcgccttcctcgtccggcgcgtactcctcctcgccctcttcctcctcgccctcttcctcctcccccttcttgccgagccgggccgtacggtcgctgagggcatcggccagcgagctcatgccccggtcggcggcggcggtcaccgccttacgacccgcgtcgagaacctcccccctcaactgctcctgcaactgcgcgaactgcggcatctcgcccagcctgcgcatcccttccgtggcgagctgacgaggttcgaggccgaatcgtcggcccgccagataggtcgcgatggacagagccatccggcccttcttcgtccgtcccagcacatagccgcccacgacagcggcagcgagcgtcaccttggccgtgtcatccatgagtcgtcaccttcgatcgttccgcgcggagccgacctgtgcggcgtgcagccggtcgagcagccgttcctcttcccgttcgaactcctccaggctgatgtctccgtcttcgagctcctggttcagcaccgccagctgggcgcggagcacccccgggtcgtgcagctcgcgctcggctgcctcgttgagcttctccgccacccagatcaccccgcggaccggtgcgacggggaacgtgagcaggccggtgagcagtcccatgtcagactccggccgtacgagcgtgaggggcttcagcggagacgaagctgtaacagggcagcgggcccgcgaggcgcagctcgacgtgtgtgcggtgccggtcggcgaatcgttccgccaccctgtggaagtcgtcgctgtcgccgcggctgacgaggaacgacacgttgagcacgcatccctggacgtccggccccggggccaccgcacgggccaggggggtgagctcgcggagaattcgccgcccggcttcggcggccctgctctgcagtgctgtcgtcacggcttcgcccagtcggaggctggcttcgtaaccgggacgtcgacgcgcttcgtcccgcagccgccggaccttcttgtcctcggcgacgaggtcggccagtgcgttctgtgccgggagcgccttgacgttgatctcgaccccgtcggagagccgctccagtgccgcgacgtggtccgcctcgtcggctgccagccggccgcgcaccgtctcctcgtccggtgcgaccatcccgaaccgcatgggcagtaccgggccctcggccgaaaggcgcagcaacagttcctggtgagccagcagatcgcgccgtctggcgcgcagtttcgggggagcctcactgacgacggcggcgaggcgcccctgccggatcgtccgcagcggggcagccgggctgcccacgcctccggcgcccgtaggcagcggtcttcccgcccggacgatcgcgtagacgtacacaccttcggctgtcacgactcatgcctccacgggtcgtcgtcggctcgcgccgctgcgggcaggagcgcgccgcttcctcggccgttcctcctgctgctcttcctcgtcctcgtcgggctcttcgtcctcgtcacggccgcccccgaccgccttgcgcacggtgtcacccacggactccgcggccttgcggaccttgcgcttgcccatggacttgacggcacctcccccgatcagctccggaacggtggtgctcccggagtcacgctccaggtcgagccggttgcacgcttccgcgaagcgcaggtaggtgtccacactcgccacgacgatgcgcgcgtctatcttgaggatctcgatgccgaccagggagacccggacgaacacatcgatcaccatgccccgatcgaggatgagttccagcacgtcgtacaacgtgccggcgcgcggcggacacgccactacctcgtcggagtaggtggtcgggggcatggggcgtccttccggttgtcgggcaaacctggatcactcgtcggcggacccccgccgatagcggcggaccctgcggtactccatgagttcgccgtcctgatcgagctgcacctcgtacgaggcgagaaggctcgttgtgtccggaatccgggccagctcaaggacgtccacgacgacgcaccagccgtcgtcggcacgcctcaccgccgagacgccctccgtgggatggccgatcagcccctccaggctccggctggcagcacgggcggcgccttccgctccacgcacggacggcgtgcggcgagcggcattcgtcgaggatttcccggcgcgcggccgacgctcttctgccatgaattcaagtctgatcgctatcgggcgccgcgcaccttgggcgagccagtcgggcgcacgtgccggggacgcacgctgccgacgggtgcgtgcgggccgctccagggctgcgggcgcggcgcccgcagcccacgcccggcagggtcgaggacgcaccggtgccacgtgacgtgacaggtgatacgcacgaggcggcgcgctacctggcagccaggcggcaccgtgcacggccagaccgaacagacccagaccgaacagacagtgctggacgcgccgacggccgcgtgcgccgggagccggagaagggtgcctctaccagtagtgacgcctgccgcccaccgcatgcccgacggcgcccagaatccagagaatgaggccgatcacgacgagcacgacaccgatggtccacaggatcgatatgcccgtcagcaggccgatgaccagaagaatgacgcccaggacgatcatggcgccctccgatctcgtaggctttttttcagtatgcgcccgacgcatccgcaaggcgacgcagagcatcggcgccccagggagagccccgccccgacgacgcgacggtcctcctcccgggaaggtcagagttccgcgtcgccgcgtggtgcgacatggaagtcgaacgcgagggtccccggatcaagggccgtcgccccaccgtcaagggtgagcactgagccattgacgtacgaggccgccggggagagcagccagctgatcgcctccgcgatttcacgcggttcgcccggccggcccaggggcaggaacctggtcgcctcctcgtaggcggactccacactgccgtccttcaggtccgcttcctcggcgaagcgcgccatgcgccggtcggccatctcgctgcgcacccagctgggacacacgatgttggcacgcactccctgccgcccgtagtcgacggcgacggaacggcagagttgcagcagggctgccttggacgtggcgtacgggacgttgctcgcgccgttgcgcagcgcggacaccgaggcaaccgcgaccaccgcccctttcgtgtccagcaagtgtgggatcgccgcgcgcaggagcagcagcggaccggtgacgttggtgcgcatcacgtcgtgccagtcctccaacgacacgtccccgacagctccgccgcgcccgatgcccgcgttgagcacgagcccgtcgagtcgcccataggcggccagggccgtgcggacgagaccgtcggcagcatcgggatcacccacgtcggacggacaggccagtgccccggtctcccgttcgagccgccgcagcggttcggcccgccgcccggagatgaccacgtggtgcccaccctcacgcagcagccgggcggtggcttccccaatgcccgtacctccaccggtcacgatcacaactcgcttctctgccactgcggttcaggctcctgctccgggttcgggaaatgcgtccgatcctacgtcggggctgtgacaccgaacctcgagcacatgagccggtacgcggtgtgcgagatggccggccggggcttggccggtgcgctttcctcggccgccctcggcacgaactatgggtgaatcattgcgtaattccaggacattcaactaaatttccgacagccgcttcgagatgtcgtcggcagacggggggcaaaggatgagcacggacgaccgcgtcgcggtgacacccgggatcgcacgaccgcacgcgtcgcccggacttgccgggcccgaccggctcggactggtgaccgaccgcaccggcgccctccccgacctgcgcccggccgcgcccaggctggtcggcgacagcgacagcgacgtgtacgacgtctgcgtcggggtgtcccactcgggaaccacgcccgagaccgtcagggccctcggcccggcccaccgcccccgccgcgcgataaccgctgccctcaccgacgccgcgccctgccccgtcgccgacgccgacgccgcggacgccgccctcggcacggtggtacgcgaaacgggactgcgccagggcgcgatttccgtccgcatcgcccaactcgccatcgtggaccgcgtcctgatcgccgtgacgcggcgcaccccgcaccaggccgaggcagcgccgcgggccacgttcgacaccgtccatgacctgcgtttggaaggacaaccccgtcgatgaccgatcgcacgacgacatcccgggccgggattcgcggctttcgcgcgggcgacggcccgcagttggtggaggtatggcgccggagtgcgcctgccgactccatcaccccggaccgcttccgctccctggtgctgctcgacgccaatttcgatccggaggggcttcgggtcgccgtcgacggcgaccgtgtcgtcggcgcggcctacgcggtgcgccgtctgacgccgatgaccggcaccgacctggagccggagcagggctggatcccgttcttcttcgtcgacccggccgcccgcgggcacggcctcggccgccggctgctgaccgacgccctcgactggctgcaccgccacggccgcacccgggtggacttctcctcatacaccccgaactacgtcctccccggcctggacgccgaggcgtacccggaagccgccgggctccttgagtccctgggctttcgcactctgtacgaggcggcggccatgcaccgcggcctggtcggctatcgcgtcccggaggacgtcgcgcgccgctcggacgaactgacagcgcggggctaccggttcgccaccccgtgcgacgacgacctggtggacctgatcgcgctcgccgggaaccacttcggcccggactgggcgtgcacgatccggcagtgtctggccgcgggcacaccgctcgaccggatcgtcgtcgcccgggacccaacgggtcgcctggtcggctgggcgatgcacggcacgttcgatgccgtggacgagcggttcgggccgttcggcgtgctggaggagatgcgcggcaccggactcggcaaggtcctgctccacctggtcctggagcggatgcgggcgcgccgcgcgcactccgcgtggttcctgtggaccggcgaacagtccccggcgggccacctgtaccgcaggagcggtttcaccacgacccgggtgttccgcgtgctgcgccgggaggccgccggatgacgccgtcacaccgcaccggcggcctgagccgccgtcacttcgcgctggcgctcccctcggcgctgctcgcctccggagcttttggatgcgccgcgccgcaccagggcaccgggcggcccggggacccgatcgtcctcaccctgctctcccactacgcgagcggggagctcaagaaggccctgcggggcccggtcgacgagtggaacgccacgcacgaccgggtcaaggtgcggacgaaggccgtcgagttcacggacctgctgaccacgttcatggtccggcaggccgcgggccagggcgccgacatcatccacccgtactgcctgtggaacggccagctcgtccgggccggcgtcctgcggcccgctccgtccgagcacgccgaggagatcacgcgcggctacggcacggccgcggtcggcgcctcgtcggtgggaggcgaggtgtacggctaccccaccgaggtgcagacgtacgccctctactacaacaagcggctgctgcgcgaggccggcatctccggccctccgcgcacctggcgggagctggaggagacggcctaccgcaccgccgcgcgggaccggtacggcaacacactggtccaggggttcgggctttcgacctacgacgactccaccaccgtcggccagaccctcgcactgctcaacgccgccggcggaaggttcgtctccgcggacggcaggagcaccgccatcgactcaccggccggccgggccgtgctcgatctggagcaccgcctcgtcgtcaaaggcgcgagcgcccccggcgtcaacgtctacaaggcgttccagtccgggcaggtggccatggtggtcagcgccggctggtggaccgcgagcctgaaggcccagatgggcaaggactaccgcgatgtcggcgtcgcgcccgtgcccgtccccgaggcggacgacaagcgcgccacgctctccaccggcttcatgctgggagtcaacacggccagtgaccacccgcgcgaggcctgggagttcctgcgctggctgaacaccgagaaggtgagcgcgaagagcgccgagaagggcgcgacagcgacccggatgagctccctacaggtgtcggtcggctccctgaccggccgcgccgacgacatgcggacgctcctgagcgaaggcggcgatccgaacctgcgcccgttcctggacgcgctggcgtacgcggtgccggagccgaacgtgccgggcgcgcagcaggccaagtcgctgctgcgcaagaacatcgaggcgttgtggaccggtcagcagtcggtcgacgaggcgctgcgcaccatccgccgtcaggtcgatcaggaggtgtcgcgctcatggtgaacacgttgaccccggagacgactgagcgggcgcacggcccgcggtccgccgggcccgccgtcaacggccgcgcccagacccggcgccggcgccaccaggccgtcgtcgcctatctcttcctggccccggcgttgctgttcttcgcggtcttcctgatcctgccgctcggcttcgcgctgctgctgtcgacgtcccgctgggccgggttcgacctcggcgacatcgatccggtcggcctggacaacttcaccggcctcttcgcggacggatcgacgttcctgacgccgatcctcaccaatacgctgctgttcgccctgggcaccgtggccctcgcgctcgccggctccgtgctcgtggccacctgcatcgacaacctgcggttccagggactgtggcgcaccctgtacttcctgccgatcgtcacgaccgtcgtcgccgtcggcaacgtatggaagtacatgtacgagccgggcggcctcgtcaacggcgtcctcaacgccctcggtctcggctcggtggcgttcctccaggacccggacaccgcgctgccctcggtcgtggtcgtacaggcctgggcgtcggtcggctcggcgatcctcatcctgaccgccgggctgaagtccatccccgagtcgtactacgaggccgccgcgctcgacggcgccgggcccggcaccgtcttctggaagatcacactgccgctgctgcggccgtccctgctgttcgtgtgcatcacccagttcctcaccggcctgcagtcgttcgcgctgatcatcgtgatgaccaagggcgggccgggtgacgcgaccaatgtggccgcgctggagatgtaccggcaggccttctcgtacggcgactggggcacggcgagcgccgccgccttcgtgctgttcgtggtggtcctcgtggtcaccctggtgcagttgtggatcttccggcgcaagggggaggacgcatgaaccgccgccgtttcccgtggttctcgtacctggtggtcgtgaccggcgccgtgctcacggtggtgccgttcctcgacatggtgatgacgtccttcaaggggcccggcgagtccggcacgctgccgtaccggttcctgcccgaggcgttcgacctgtccaactaccgggcggcggtcgcccagctcgatctgccggtgctcttccgcaacagcgtcatcgccaccgccctgatcaccggatcggtgctgctcacgtcgtcactcgccggctacgcgctcgccaaactccgcttccccggccggaacttcatcttccgcctggtgctgtcgacgatgatgttccccccgttcctcttcttcatcccgcacttcctgatcctggtgcactggccgctggcgggcggcaacgacctgttcgggcgcggcggcgcgggcctgaccgtcagcatcgcggcgctcgtcgtgccgttcctcgtcaacggcttcgggatcttcctgacacgccagttcatggtgtcgatcccggacgaggtcctcgaggccgcgcgcatcgacggggccggcgagttcgccgtgtggtggcggatcgtggtgccgcagaccaagccggtcctggtgacgctcgggctgctgaccttcgtcgacgcctggaacgagtacatctgggcgctgctcgtgtcgaccgccaacccggacgtgatgaccctgcccgtcggcatccagctcctccaggactacgtcgacccgacccgcacgatgcccatcgtcatggcgggcctcgccctgagcatcctgccggtcctgatcctcttcctgctgctgcagaagcactacatccgcggcgtcatgctcagcggcctcaaatgaagaacgaatccgtgacgggcggaagaacgagggcgatcctcgcccgcacgcccgacgaacgcgaccccactcgccgggcgcgccccaggctccgccagcgtcaacgactggacctcgcggcatgaaacggaagtgtcgggacctgatgggtcacttcacatgtcttcgtgcccgtagcccggacgctcgcgtcccgctccgcggccgggagcgggacgcgcgaggttcctctcagtgggcctcggcggcctgattggtccagacggcgtacatctgggtgtacttgccgtcggcggcgaggagctggtcgtgcgcaccgacctcgacgatgcggccctcgtcgacgacgacgatgcggtcggccttcatcgcggtggagagccggtgtgcgatcaggatcgcggttcggccctccagcagcacgtccagggcctgctcgatcttggtctcggactggaggtccaggttggacgtggcctcgtccaggaccagcacccggggctgggccaggaaggcccgtgccagggcgacgagttgccgttcgccggaggacagcgactggccccgctcctggacgacggtgtcgaggccgtcgggcagccgctcgaccacgtcgaccaggccgaccacccgcagcgcctcccgcacccggccgtcggaggcgtccgggacggcgaaacggatgttgtcccggagcggcccggcgaacaggaagggttcctgcggaacgacgccgatctgccgccggagggactctatccgcacgtcccggaggtcgcgcccgtcgatgaggatccggccggacgtcgggtcgtagaaccgggtgaccagtttcgcgagggtggacttgccggcaccggtggggccgacgaacgccacggtctcaccggcccggatgtccagcgacacctcggagatcaccggccggtcgggaacatagccgaacgtgacgtcttcgaagacgatctcgccctcgaccttcggcaggtcgacggctccgggagcctcctcgacctccgcccgcgtgctcaggagctccctgagcttcacgatcgacgactgcccctgctggtacgtgttgtagagctgcaccagttgctggatgggctggaagaaggcgcccagggagagcaggaacgtcaccagctcgccgatggtcagctccccgtcggcgaccatgccggcgccgatggccagcagagcgagctgcccaacgacaccgatgacctgggtgctcggcgtgtagatcgagttgatccgtccggtgcggacattggcgtcgtagtacgtgcccgtgacctgtcggtgttgctcgatgttgtgctgctgccggttgtgcgccgttacgatgcgcactccctgcaggctctcggagagatcggcgatgacggcggcgatggtgtcccgcacccgcacgtagcccttgccggacgcccggtggaaccacacggacagcgcggtcaggacgggcacgaccagtacgacggtgatcagcgccagccgcacgtcgaaggtgaacagcaccaccgtgacaacgaccatggtcaggccctggacggcgagctgtgccagaccgtcctgcagcaacgcctggaggttctcgatgtcgctggtcatccgggtcatgatcacgccggacttctcgccggtgtagaagttcagcgagagccgctgcaactgggtgaagacccgtacccgcaggtcgttcatcacccacgcggcgatccgcccggtcaccttgacccgcgcggcctgcgcggcaccggtgaccaccagactgaccaggtacgcgatcgcgaccagcaccagcgtgccggagtccttcgccgtgatgccgtcgtcgatgccgatctgggtcagcttcggaccggcctggagcgtcagcgcctccagggccacgaacacgccgcccagcagcgcgatcggccagtacgggcggatcagccgccgcagactcagctcggcgccgtcgggatcgggccggccgtgctcgaacacgacctcgggctcgggatgttccggctcggtcttcagcaacgtgtcgacgctcgcctgcatctccggcggcactccggcgaagggcagacctggcgcggtggccctgccgcctccgttgaacgcggcgccacctcccgtgggagacgtcatcggcccacactccccagttcctcgatggtctcgtccgcctgcgccagcacttccgcgtacagcggcgtgctcgcgagcagctccttgtgcgtgccgtccgcgacgatccggccgccgtccagcagcaccacgcggtcggccaggctgatcgtggacagccggtgcgcgacgatcagcgtcgtccggccggcgaacagggaccgcagcccggcgtggatctcctgctccacctggacgtcgatggcgctggtggcgtcgtcgagcaccagcaccggcggattcagcagcagcgtccgggcgatcgcgatgcgctgccgctgcccgccggacagcgtgtagccgcgttcgccgatgacggtgtcgtagccctcggacagttcggtgatgaactcgtgggccccggccagccgggccacccgctcgatgtcggtgaagtccgcgtccggccgcccgtaggcgatgttgtcgcggaccgacgccgagaacaggaacggctcgtccagtacgacgccgacggtgtcccgcaggctgcgcagggtcaggtcccgcacatcgtgcccgtccacgctgacggagccggcgcgcacgtcgtagaaacgcggcagcagtctggccgcggtggactttccggtgccggtccggccgaccagcgccacggtctcgccggggcggagctgcagcgagaaccccttcagcacgtcgaggccgtcgccgtagccgaaggtgacatcgtcgaaccggacgtcaccgcgcggcccggtgatctcccgcgcgtcgggggcgtccgcgatctccggcttctcgtccagcacctcgtacagccgcttggccgcggccgacgaccgctgccccagcatgatcaggttgccgatcacctggaacggaacctggagcatcaggagataggcgttgaaggccaggatcgcgccgacgcccagctcgccgtgaatgaccaggtatccgccgtacagcagcacgatcgccatgccgacgcggggcaggttctgcaccaggggcgtccaccgcgcgcgcagatcggcgtccttcacgttcgcccaggcgacgctcgtcgcggccttctgcagcgaggcgagctggctccgctcggccgcgaacgacttgaccacgcgcacgccgttgacgttctcgtccaccacggtcgcgacatcggccagccgggcctggatcagccaggacaccgggaacagggaccgttgcatgcgccggctcgccacgaacatcagcggcatcggcagcatggccaggatggccagcggcacgtcgatcgccagcatgtacgcgaacgacaccagcgagataccggactgcaccagcaggtacggcgcgaacgccagatacatctgcaccgcgcggatgtcggagttggcacgggagatgagctgcccgctctgcatccggtcgtagaacgggaacgacatggcggtcaggtgctcgtacacgatgttgcgcaggtcgtactcgatcctggccgcggcgcggaagagcagttgcttggacaggtagccgacgaccagcatgatcaccgacatcccgaccagccaccacatgtagtgcgacagcggcaccctgtccgacacgatcgagttgtccaccgcgtcctggatcagcctcggcacctgtacgaccaccagcatgctggccccggacatcaccagggccgcgctgaacatccaccggtgtgcccggaccagcggccacgctcgccataaccaggacctgctcgggtcggggtcgatcgccgcgctgggcggcggatacgtcttgttcacctgaattcccctctgtgcatgccctcgcgggcgacccactcggcctgctcaaggcagcatcaactgcacgtggaacaaggcgtgttcgacggtccacgtgtaagccccacggatgcaggatagcaaaagaaggtacgacgtacgcagtttgtttttttcggtgacccgtgcgagcctcggtcgccgggcggggggccgacgagcggaccccgaggtcgcggaacgtgcccttccggtccgctcgcagacctgaacggtcgatgcatgctccacccgcaccatcaaccacgcggaggtcggatcattggttaccgttgtcttcggcgcacgtggaaacgtcggccgcaatgtcgctgccggcctgctggccgtcggcgagaaggtcaggggcaccagcagaaacccggaagcgggcggctttccgtccacgctggaggtcgtccaggccgacttggagcgccccgagaccctgcccgcggtgctggccggtgccgacaaggtgttcctgtacgccaaaccggagcagatcgaggcattcgtggcggcggcgcagtccgccggcgtccggcaggtggtcctgctgtcgtcggtgtcggtcgtgatggccacctccgaacagaacccgatagcccggatgcaccggacggtcgagctggccatcgagcggtcggggctggactggacgttcatcaggccgggcatgttcgccaccaacgcccgttggtggtggggggaatcgatccgcggggagggcgtcgtgcgccttccgtacccggaagcgcagaacgcacccgtccatgagaaggacatggccgcgctcgccgtgaccgctctgaccgagcccggccactcccaccaggcctacaccgtccacggatccgagtcgctgacgctgcggcgccaggtggagcacatcggtgaggccctcgggcgcccgatccgggtggagacggtctctgtcgagcaggcgcgggaggaattcgccgagaaggcgccgtcgaacgtggccgaggcgctactgcgcatgtgggccgccgccgacggcgttccggccccggtctcggtcatcgtcgacaggatcaccggcaggcccgcgcacacgttcgcgcagtgggccgccgaccacgccgacgacttccgctgagccgtcctcctcggctgaccgccgtgcggtggtcagccgaggagcagcgagatgcccatgggtggactccgatgtctacgactccggccagggcaggtcggtcgcgaccgggacggtgtagtcgacgccggggacgtcgaagccgtacagggcacggcactgggcccggaaccacgcggtgtcggccagcgcggtgacggtctcgggagtgatcgaccgccagcgttcggccaccgccgcctggaccggctcggacagctcccagcgatcgaggcggatgcggccggagtcgtccacgtcgggccggcgcgcggtgagctggtgccacaggtcgagcgactgcgccacgggggacgggaaacggtcgccgagaacgccacggagcagactcacgtagagcgggatgcccgggatggcggtcagcgcctgggtgaccagggcgccgttcaccgaggtgaaggcgcggccgtccaccgcggccagccgctcggtcagggcgcgcgcggtggactccaggtgggccttggcggcgccgatcgtgcccccgcggtagatcgccgaggtcagcggcgagccgatgtacgtgagggcgaccgtgcggaagccgctccgcagcagcccgcgctcggccagcgccgtgatccagcgggaccagtcctcgccgcccatgacccccacggtcgcggcggcctcggcctcggtcgccggggcgaccgtgacctcccgcacctgcgcggctccgtcgtcggcgaactccaggttccgggtggtgtgcggcgcgccgagcggcttgagcaccgactggtaggtcgtgccgctccgcgggtcggtgcgccggggcgcggcgacgctgtagatcaggtagtccacgccgccgaaccgctcggccagcagatccagcgtctcggtcttcgtggtgtcggcaaaggcgtcggcgttgcggaacgagaagtccgccccgagctcgcgggcgatcgcgtcggtggcgaccgtgcgataccacccggcggtcgcgctgcgatgcccggccggccgttcgaggccgatccccacgccgtcgatgccgtaccgcaccagcccggcgatcgtgctcgccagaccgtagcccgagctcgacccgatgaccagcgccgtgggccgccgcgccggtggcttctccgggaccggcacctcggcccgcatcagctccacgctgcggaagcatccgaccggatgcgcgtcgagcagaagatagccacgtcctgtcggtttcacgacgcgctcagactgtgtcatcgatgggggcatcatcggctcctctgccggatcggttgtcgagcagtgcctgcttgaggtgctggaccaggtcgtccggtgtcgaccggtggaacatcgacgcggtgtccagacgcacaccggtcgccgagtcgaggcggttccgcagggtcaggatggacagcgagtcgaagccgaagtcgagcaggatctggttcggccgcaccacgtcggccgactccagcccgagcaccgccgagatctgtgtggagatcaggccggacagcgtccggtcctgttcggcctccgccatcgacgcgagccgttgccgcagcgatgtgaccgagaccgcgcctccgctcgccgtgcgtttgccggtggtcttgaccagcgacctgaacagcggcggcagcgcctccccggcctcggcctgcctggtcagctcggccagatccagcctggccgggatccacacgggttcgtccgcgcggcaggcggtgtcgaacagcgcgacggcctcccgcgcccccagcacgcccactcccgcgttcccgccacgggacggtgcgtcgtccgccgtccagggcccccaggccagcgacaccgcgggggcgccgcgcgcccggcgccgtcgggccagcgcgtccagcgcgaccgctgacgcggccgtggcggcggttccggcaccaccgacggttccggcgaacgacgagcacaggacgagggtggcctccccgatctcctggtcgaggactcccgcggcaccgaccatcgcgcccaccacctcggcgagcgcgtccggggcttgagacggtggcgcagacagggttctgtcgtgcggcggagcctgcggtatgtgcacgaccatggtcagcggacgctccgcgggcagacggccgatcagctcccgcagcgccgtgcggtcggccggatcgcacgccgcggtggtgacggcggcgcccagcgcggtgagttccgcggtcggctcgggggcttcggcgccggtgaacagcagatgccgtaccccgtgcacggagacgaggtgccgcgccagtcgctcgcccatgggtgtggtcccgcctgtgatcagcacggtgccctcgtggccggcgaaccgctccctcgtacccaccggtgcgcccggggcgagccgtggcaccctgacccgaccctcgcgcagggccatctgcggctcgccggacatgacgggcctcggcagcgcacgccaggacgcctcgtcggcgtccacgtcggcgaggacgaaccgtccggggttctccgcctgcgcggaccggacaagcccccacaccgcggcgcccgcgaggtcggcgccggcagggtcgaaggccggcacggcggcggtggtcaggaacaccacggtcgccgtggcgagcctctcggccgactgcaccgcgttcagccggctcagtgtctcccgcacggtggcggcgacctccgcgcccgtcggcacggtgagcagcagatagtccggcgcgtccccgtcggcttcggccagggcgtcgagtcccgggtatgcccgggcgtacacgcctgcggccgtcagccccgccgcggcgcggagcggatcctcgcccacgacggcccagttcgccttccggggcgacgacttcgcgaggtggtcgacccatgcctcccggtggagcacgccgagttgtacgaccccggcggcccgcagctccccgggttcgacgggcgtggtaccgacggtgaactcggcgaccggatcacccacggtgtcggccagcgtcaccgacaccgagccggcgcggtccgggccgatccgcacccgcagggcggacgcgccgaccgcgtgcacggcgactccgcgccacgatgtcgccagccgggggccctcggtgcacgcggcgtggagggtggcgtcgaggagggcggggtggatggtgaaggcgtcgggctcggtggggagggagatctcggcgtagacgtggtcgttgtggcgccacatccggtgcagcccctggaacaccgcaccgtagtggtacccctgggcggccagggtctcgtaggagacgtccacgggccgtgccccggcggggggccaggccgtgaggtcccagtccggggacggcgtctcggcgtccaggacacccgtcgcgtgacacgtccaggacgtggccgtgcccatgtccggccgggcgtcgatccgcaccgtacgcccgctctcaccggcggccggctcgctcacctccacccgtagccgtacggcgccgtgctcgggcaggacgagcggggaccgcacggtcagctcacggatgctgccggcgccgacccggtcggcggcgtacaccgccagctccacgaacgcggcgccgggcaccacgagggtgccggccacctggtggtcggccagccagggatgagtggccagggacacccggccggtgaagaccgtgccggccgcaccctcgacgacagcaccgagcaggggatggccggccgcggtcagcccgaccgcaccgacatcacgacggccggtgtccggggtcagccagtaccgcgtccgctcgaacggataggagggcagggtgacatgtccgccacggctctggtccgccgggttccagcggtcgacggcccccgcggtgaaggcatccccggccgaccacaggaagctgtccaggccaccgtgatggcgacgcagagtcccgatggcgcgggccggagtgtgcgtgctgtcgatggtctcctgcacaccggcgaccagaaccgggtgcggactgcattcgatgaaggtgtcgaagccgtccgccagcaacaaccgggtgacggcctcgaactcgacggtttcgcggagattgcggaaccagtagtccgcgtcgagctcggtggtgtcgatccgccgcccggtgacggtcgagtagaagcggaggtcaccggctcgcggggtgatcggcgccagcagatccatgacgttctcgcgcagtcggtcgacgtggcaggagtgcgaggcgtagtcgacggggatacgccaggtacgcacgttctcggcctcgaacacggcctgcagctcgtcgagagcccccgcgctgccggagacgaccgtggacgtcggaccgttgatcgcggcgatctcgacatcgccgccccaccgccccagacgcggccgcacctcgtccaccgacagcccgaccgacaccatcccgccccgcccggccaaggcccggatcgcctgactgcgcaacgtcaccacacgcgccgcgtcctccagcgacagaacccccgccacatacgcggcagcgatctccccctgcgaatgccccacgaccgcatccgggcgcaccccgtgcgcctcccacaacgccgccagcgacaccatcaccgcgaacaacgccggctgcaccacatccacccgcgacagcagcacaccaccgtcatcgctcagcagcacatccagcagatcccactccacgaaggcggacaacgccttcgcgcactcctcgagacgggccctgaacaccggagcacccgcatacaactcccgcgccatcgcaccccactgcgaaccctgccccggaaacaccaacaccgtcccgccggccccggcgacccccgtcaccacgccatcgcaaggagcaccctccgcgagggaacccagccccaccagcaactcctcacgcgtggcacccagcaccacgccacgccactcgaacgcggtacgggccgccagcgtcgccgccacgtcctccaacggcaccccggtatcagcggcggcctcggcgatccgccccgcgtgggcccgcagcgcctcctcactccgcgccgacaacacccacccgaccggccccgcctgctccgtgaaagacaccggccccgccggcaggacggaccccgccggcgggacggactcctgcggcaggacggactccgacggcgggacggactccggcggcagtgactgttcggccggcggcgcctgctccaaaatcacatgcgcgttggtgccgctgatcccgaacgacgacacccccgcacgacgcggccggccctccgaacgccactcacgcgactcggtcagcagccgaactcccccggcactccagtccacatgagacgtcggctcatccacatgcaacgtggcgggcagcaccccacgacgcagcgcctccaccatcttgatcacaccacccaccccggccgccgccatcgtgtgaccgacgttcgacttcagcgaacccagccacaacggccggtcctccgaacgccccttcccatacgtggccagcaacgcctgcgcctcgatcggatcaccgagcctcgtccccgtaccatgcgcctccaccacatccacatcacccgcgcccagccccgcatccgccagcgccagacgaatcacacgctgctgcgacggaccgttcggagccgtcaacccgttcgacgcaccgtcctggttcaccgccgaaccccgcagcaccgccaacacccgatgcccacgggcacgcgccaccgacaaccgctccagcaccacaagacccgcaccctcaccccaaccggtcccatccgccgactccgcgaacgccttgcaccgcccatcagcggacagcccacgctgccgggagaactccaccaacaccccgggcgaggacatcacgctcacaccaccagccaccgccagggagcactccccgctccgcaccgcccgggcagcctgatgcaacgcgaccaacgacgacgaacacgccgtgtccaccgtcaccgccggcccctccaaatccaggaaatacgccaaccggcccgacgtgacgctcccactggtaccggtgagcagcagcccatcggcctccgcggacccctcgtgcatcggcggcccgtagtcctgcgacatcgcgccgatgaacacgcccgtgtcgctgccgcgcagcgatccgggctcgatcccggcgtcctccagcgtctgccacatggtctccagaagcagtcgctgctgcgggtgcatcgccagcgcctcgcgcggcgacaccccgaagaacccggcgtcgaactcccccgcgtcgtcgaggaagtagcccttgtccacgtagctcttgccggtccgtccggggtccgggtcgaacaggttctccagatcccagccacgatcgcgcggcagcccggacacggcgtcccgacccgaccgcaccagctcccacagagcgtccggcgacgacacgccaccgggaaaccggcagcccatcccgacgacggcgaccggatcatcgtcctccgccgtggcggccgcagcggccggagcgacggcctgggtgctcccgccgagcagctcctcgcgcaggaacgcggccagcgcggacggggtcggccggtcgaacgccacggtggccgacagccgcagtccggtgacctcgttgagccgcttgcggagttccaccgcggacagcgagtcgaggccgagctccctgaacgcgacggccggctgtacggagtcggcgccggcgtggccgagcacggtggcggtgtgggagcgcaccagatcgagcagctcgcggtcgacgtcctcggccgtgtggccggccagccggtcggcgagcgtcgacgcggtcgccgtgacggcggtcgccgcgcgccgcgcccggaccagcccgcgcagaacctccggcagggtcgcccccgcggcctgcgcacgcagccggtccaggtcgagcgcgaccggtgcagcggtggcctcacctcgggcgaacgccgcgtcgaacagcgcgacgccctcgtccgacggaagcggcttcagcccagtgcgcgccatgcgggcgatgtccgcgtcgttcaggccgcgggtcagttcgctgcgctcgctccagaacccccacgcgagcgaggtcgccggaagtccggtggcgtggcggtactgggcgagcgcgtcgaggaacacgttcgcggcggcgtagttcgcctggcccgcgttgccgatcgtgcccatgatcgaggagaacagcacgaacgcggacagcccgaggtccttggtcaggtcgtgcaggttccacgccgcgtccagcttcggcgtgaggacggcgtcgatcttctccggtgtcatcccggcgatcagcccgtcgtccagggtcccggcggcgtgcaccacgccggtgagcgggtggttcgccgggactgccgcgagcagtgccgagagcgcgccccggtcggccacgtcgcacgcggcgatcgtcacctcggcgcccagcccggacagctcggcgaccaggtccgcggctcccgaggcgtccggtccgcgccgggagaccagcagcaggtgccgcaccccgtgctgcgtgaccaggtgctgggcgaacagcctgccgagtgttccggtacctccggtgagcagcacggtgccgtcggtgtcccaccgtgacggcgcctccggcccgcgccggccctcgggctccggccgccccggcatgcccgcgggtccccgtgggccgtcctgggagctcgccctggccagtctcggcaccacgacccgtccgtcacgcagcgcgaactgggtggcgccgccggctagcgcggacggcagcgcggccgacgagcgagcgtcctcgtccacgtcggccaggatcagccggccgggatgctcgctctgcgcggagcggagcagcccccagaggggcgcggtggacaggtccggtacgggctcgccggatccggtcatcaccgcgcgccgggtcaccacgaccagccgcgcctccccgaagcgttcgtcggacacccaggcctggaccaggtcgagcgcacggtacagcgccgtgcgggcggctccggggacgtctgccgtctcatccccttcgatgcatacgaccacgtcggacgagtcgccgggtatcgcggacagttcggtgaaccgtcgccagtcgacgccgtccgccgtcgccgcgcgcaggccgaacgggtcgtggccgagcagcgagagccgggtgggcggtgccgcgtccgccgacggcgcgggtgtccactccaggtgcagcagggagtcccggctgacggccgcggagccgaggtcggcgaggtcggccggaagcatggccagcgacgccacctctgccacgggcatgccggcgccgtccgccgcgcgcagccgtatcgcgttgtcccccgcagtcgtcactgacacgcgcagcgcggaggcgccggaggcgtacagcgtggcgccttcccatgcgtacggcagtcgtatccggccgtcgctcggcaggacctgactcatgagtgcggcgtggagggtggcgtcgaggagggcggggtggatggtgaaggcgtcgggctcggtggggagggagatctcggcgtagacgtggtcgttgtggcgccacatccggtgcagcccctggaacaccgcaccgtagtggtacccctgggcggccagggtctcgtaggagacgtccacgggccgtgccccggcggggggccaggccgtgaggtcccagtccggggacggcgtctcggcgtccaggacacccgtcgcgtgacacgtccaggacgtggccgtgcccatgtccggccgggcgtcgatccgcaccgtacgcccgctctcaccggcggccggctcgctcacctccacccgtagccgtacggcgccgtgctcgggcaggacgagcggggaccgcacggtcagctcacggatgctgccggcgccgacccggtcggcggcgtacaccgccagctcggcgaaggcggcgccgggcaccacgagggtgccggccacctggtggtcggccagccagggatgcgtggccagggagatccgaccggtgaggaccaggctggtcgccccctcggtgaccgcgccgagcaggggatggccggccgcggtcagcccgctggcggcgatgtcacgtcggctcgtgtcgggctcgagccagtaccgcgtccgctggaaggggtaggtcggcaggtcggcatgacggccgtcgtgcggacgtgcgggcgtgtgctgggtggtggcgccggcggtgaacgcctcgccggtggagcgcaggaagctgtccaggccaccgtgatggcgacgcagagtcccgatggcgcgggccggagtgtgcgtgctgtcgatggtctcctgcacaccggcgaccagaaccgggtgcggactgcattcgatgaaggtgtcgaagccgtccgccagcaacaaccgggtgacggcctcgaactcgacggtttcgcggagattgcggaaccagtagtccgcgtcgagctcggtggtgtcgatccgccgcccggtgacggtcgagtagaagcggaggtcaccggctcgcggggtgatcggcgccagcagatccatgacgttctcgcgcagtcggtcgacgtggcaggagtgcgaggcgtagtcgacggggatacgccaggtacgcacgttctcggcctcgaacacggcctgcagctcgtcgagagcccccgcgctgccggagacgaccgtggacgtcggaccgttgatcgcggcgatctcgacatcgccgccccaccgccccagacgcggccgcacctcgtccaccgacagcccgaccgacaccatcccgccccgcccggccaaggcccggatcgcctgactgcgcaacgtcaccacacgcgccgcgtcctccagcgacagaacccccgccacatacgcggcagcgatctccccctgcgaatgccccacgaccgcatccgggcgcaccccgtgcgcctcccacaacgccgccagcgacaccatcaccgcgaacaacgccggctgcaccacatccacccgcgacagcagcacaccaccgtcatcgctcagcagcacatccagcagatcccactccacgaaggcggacaacgccttcgcgcactcctcgagacgggccctgaacaccggagcacccgcatacaactcccgcgccatcgcaccccactgcgaaccctgccccggaaacaccaacaccgtcccgccggccccggcgacccccgtcaccacgccatcgcaaggagcaccctccgcgagggaacccagccccaccagcaactcctcacgcgtggcacccagcaccacgccacgccactcgaacgcggtacgggccgccagcgtcgccgccacgtcctccaacggcaccccggtatcagcggcggcctcggcgatccgccccgcgtgggcccgcagcgcctcctcactccgcgccgacaacacccacccgaccggccccgcctgctccgtgaaagacaccggccccgccggcaggacggaccccgccggcgggacggactcctgcggcaggacggactccgacggcgggacggactccggcggcagtgactgttcggccggcggcgcctgctccaaaatcacatgcgcgttggtgccgctgatcccgaacgacgacacccccgcacgacgcggccggccctccgaacgccactcacgcgactcggtcagcagccgaactcccccggcactccagtccacatgagacgtcggctcatccacatgcaacgtggcgggcagcaccccacgacgcagcgcctccaccatcttgatcacaccacccaccccggccgccgccatcgtgtgaccgacgttcgacttcagcgaacccagccacaacggccggtcctccgaacgccccttcccatacgtggccagcaacgcctgcgcctcgatcggatcaccgagcctcgtccccgtaccatgcgcctccaccacatccacatcacccgcgcccagccccgcatccgccagcgccagacgaatcacacgctgctgcgacggaccgttcggagccgtcaacccgttcgacgcaccgtcctggttcaccgccgaaccccgcagcaccgccaacacccgatgcccacgggcacgcgccaccgacaaccgctccagcaccacaagacccgcaccctcaccccaaccggtcccatccgccgactccgcgaacgccttgcaccgcccatcagcggacagcccacgctgccgggagaactccaccaacaccccgggcgaggacatcacgctcacaccaccagccaccgccagggagcactccccgctccgcaccgcccgggcagcctgatgcaacgcgaccaacgacgacgaacacgccgtgtccaccgtcacagccggcccctccagatccaggaaatacgccaaccggcccgacgtgacgctcccactggtaccggtgagcacatatccgtcgaccccgccgtgcggggtgtcgagccgcgggccgtagtcgcccgccatggcgccgatgaacacgcccgtgtcgctgccgcgcagcgatccgggctcgatcccggcgtcctccagcgtctcccaggcggtctccaggagcagccgctgctgcggatccatcgccagcgcctcgcgcggcgacaccccgaagaacccggcgtcgaaaccggcgatgtcgtcgaggaatccgccctgccggacgtacgtccgcccggaggtctccgggtccgggtcgaacaggttgtccagatcccagccacgatcgcgcggcagcccggacacggcgtcccgacccgaccgcaccagctcccacagagcgtccggcgacgacacgccaccgggaaaccggcagcccatcccgacgatggcgatcggatcgtcggcgtcgccgtcacgaaatgccgggacgctcggcgcgccctccgcgtcgccgtgtccggtgagcttcgcgtgcaggaacgccgcgaaccgatcgggggtggggtggtcgaacaccagcgatcccggcagagccagacccagctccgaggacagcccagcgcacagctcgaccgcggtgagcgacgtcaggccgaggtccttgaacgacgtcagcggcgtcatgtcggccgcgtcgtaccccaggacggccgcgaggtgggtgcgcaccagatcgagcaggctcccgcggtcgtggacccgcgccggctccgcggcgggcgcggcctcgcgcgcctcgccgatccagtgtcggcggcgctggaaggcgtacgtgggcagcacgaccctgcggccgccgtccaacagcggcgtccagtccaccggcgcccccgtggcatgcagggtgccgagcgccctgagcagggtgcggacctccgcctgcccggtgcgcagcgtggccaccgccgccggcgcctgctcggcgagggtctcccgggccatgccggcgagtacggggtcggggccgagctcgaggtagcgggagacgcccgcgtcgtgcagggcgcggatgccgtcggcgaagcggacggtgccccggatctgacgtgcccaatagtcggggtcggtcagctcgtccgtggtggcggggcgtccggtgaggttcgagacgacggggatccggggagcgtgaaaggtcagcccgcggatggcgtcggcgaactcgtcgagaactccgtcgagatggtgggagtggaacgcgtggctgacgttcagccgcttggtcttcactcctgcggcgcggaaggactccgcggtcgcgagcaccgggtcggcgtctccggagatcaccaccgagcggggcccgttgacggcggcgatgctcacccctgacacgggcagcagcgcccgcacgtcgccctcgtcggcgttgacggccaccatcgccccaccggaccgggcggcctgcatcagccgtccgcgcgcctcgacgagcgtgcaggcgtcggacagcgacagcacccccgcgacgtgcgcggccgtgacctcaccgatcgaatgacctatcagatgcgtcggacgcgctccgaacgactccatcagcctgaacagcgccgtctccagcgcgaacagcgccgcctgcgtgtaccgggtccggccgagcaggtccgcgtcggaccacacgatctcccgcagctctccgcccagcgacggatccagttccgcgcacaccgcgtcgaaggacttggcgaacacggggaaacgcgcgtacagatcccgtcccatgccggttcgttgcgcgccctgcccggtgaacatgaaggccgtcccgccctcggcgaccgcaccggacacgacgttcggcgccggctggttggccgccagcgcggccagtccctcgctcagctcggccgggtcctcgccgatgacgacggcgcggtgcggcagcgcggcacgggtggtcgccagcgagaacccgatgtcgagcgcgtccgggccgtcctgtgcggcgaggtgtccggccagccgttcggcctggacccgcagggcccgctcggtgccgccggacacgagccagggaacggtgcccgcccgcacgccgtggttctcctcggcaggggacggatccagggcctgcgcgagcacaagatggcagttcgtgccgcccatcccgaacgaggacacgccggccacccgcggctcgtcgccgggccatgcgcgcagctcggcggcgacctcgatgcccagctcggcgagcgggatgtcgtccgccggggcggcgaagttcagactcgccgggacctggccgtgctggacggccagggccgccttgatgaggccgacgacccccgccgctccctccgcgtgccccacgttggtcttcgccgaccccaccaccagcggccggtcccggtcggcgaagaccgcggccagcgccgccgactccacgcggtcccccacgggggttccggtgccgtgcagctccacgtatccgacctcggcggaccgcgtcccggcgtcggtgagggccgcccgcaggacgtcctcctgccccgcccggctcggcgtggtgagctgctcgccgccgccgtcgttgttcaccgctccgccgcggatcacgcacacgacgtcgtggccgtacgcgtgggcgtccgccaggggcatgagcacgaccaggccggcgccctcgccgcgcacgtagccgttggcgcgcccgtcgaacgtgtagcagcggccgtccggcgacaacgcgccgaactcgctcgcggtcgccgtcgactccggcgagaggatcaggttgaccccgcccgcgagcgcccacgccgactccccgcgtcgcacgctctcgtacgcctggtgcacggcaaccagggcggaggactgtgccgagtccacgaccacgctcgggccggacagtcccaggaagaaggagatccgattcgcgaggacaccacgctggagcgaggacagggtgaagctgtcgatcgctcccgcgccctggtcgcgcaccagaccggcgtagtcgtcccccatcgccccgaggaagactccggcccggctgccccgcgccgccgacgggtcgactcccgcgtgttcgagcgcttcccacgcgagttccagcatcagccgctgccgtgggtccatcgccgcggcctcgcggggcgacaccccgaagaagcccgcgtcgaaatccgcgacgccgtcgagcagaccggccctggccacccgggtgccgacgtggacggcgcggtccgcgggaaccccaccgacggcctcccggccggccgcgagcagctcccagtacgcctcgggcgagctcgcgcccggaaggcggcacgacagaccgaccaccgcgacgacgtcctgaccactcgttttcacgaagttctctgtcatgacagcggaatctcactctgctctcgggaagggtgggctcggccggtgccgccgctcgcaaacctctcgtcccggcaatgcgacgaaggttgtagaggacacgatccgactcggtcaccggggtgggaccttcgcctcgcagcattgcctgcccggcaaagggatcggcagagtctgggtcgaggcccgacccgacgttcactgtgtggaggcattagcccgtgttgcgattccaggcactcggccgcctaaccgtcaccaacgacctgggcgactgcacgccgaccgcgccgatggcgcggcgggtgctggcgcagctgctcttgtgctcgaacaacatcgtcatgctcgacgcgatcatcgatgaactatggggtgacaaaccgccgaagagtgccgtccccaccgcgcagacgtacatctaccagctgcggcgtcagttcgaaccgtgggtgccggagggtacggtcgagcaggtgctcgccacctgcggcaccggctacatgctccgggtggacccggaccagctcgacctggcagcgtttctccggctgtccaagcaggggcggaccgcgctcgccgccggcgatccggccgcggccgcgcggttactgagacaggccctcgatctctggtcggggccggcgctcgccgatgtgaccgccggcccgtcgatccaggcgcacgtcgtccatctcacggagcagcgggcgcacaccgtcgaactgcgcatccaggcggacgcaatgctgggacggcaccgggaactggtcggggagctgaaggcgatgctgctgacccacccgctcaacgagtggtaccacgcgcagctgatcaaggcgctggcctccagcggcaggcggaacgaatcgctcgtcgcctaccagcatctgcgccggacgctgtcggccgaactcggcctcgaaccctcgggggtgctgcgggaactccatcaggaggtgctggccggacgcgactcctggtcggactggggggtctcggggaggcccctcgcggagcagctcacccggtagtcaccgccccgcggaaagcacggggatggatcgaggatcgccgcgcggcgatcctcgaccgcgccggtgtcgtcctacctgttgtgcaggagccggccgccgtcgacgaccagggtgtgcccggtgatccaggatgcctcgtccgacagcaggaaggccacggcggcgcccacgtcggcgggttcgccgaggcgcctcagcgggatggagccgatgaccttgtcctccctgccctcgacgttcgcccgggtgaagtcggtgaggaccgtgccggacgcgacgccgttcacccggaccgcgggggcgagctcgttcgccatctgccgggtgaagtggttcagcgccgccttggccgtcccgtaggccgtgccgtcgggaacggcgagttccccggcgatggaggagatgttgacgatggcgccgccgtgctcgccgagccagccgtgccaggccgtctggacccaggtcagggcggacatcagattgatctcgacggtgcgccggtacgacgccagatcgacatcgaccaaccggcgggcggtccgctccgtaccgccgacattgttgaccagcagatcgagggatccgaaccggtcgacggcggtctccaccgcgatccgctggtgctcggggtcgcgggcgtcaccggcgaccccgagggcccgttcctcgccgagtgcggcggccgccttgcgcagctcgtcctcagtgcgtgaagtgatcacgacgttcgcgccccgctccaccaacgcggtggcgatgccgaagccgagaccggtccgaccgcccgtcaccagcgcggtcttgccctctaagcttgccacagtctgcgtaccttcccttgatctgcgcctgcggttattgcgccttgtcagtcggcggcatttctcccggcgtttcacccggcgcgggcgatgagcccgatggaaaccgccttgttgaccgcttcgagccgggagcgagcgcccaacttcgtgaagatggtgcccaggtggcgcttcacggttccctcggcgatagtcagtcgccgcgagatctgccggttgctcatggccttgctcaccagggtcaggatttctatctcgcgccgggtgagcttgtcctggcagttcgccgtcgtggcgatgtgcgtcagcgcctcgacggatatgtggagcacgatgcggatgttgtccgcgcacaccgcgcggatgctggacaccaggtcgttccggctcgccgacttgttcagatagccccggacgccgcagtcgagcaattggcgcaccagcgccggatcgtcgggcatgctgacgatcaggattctcgcgttcggcgaggtggagcggatagcgtgcgctgtttcggtcaccgactcgtcaggaatgttcccgtcgagcagcacgacgccgggctgttcgatctcacagtgcgcgatgccggcggcaccgctggcggcgacgccgacgacgaccatgtccggttccacgttgagcgtctcgcacaccacctcgcgcagcagcgcgtggtcgtcgatcagtacgatccgcaactggccggcgcggtcaggctgcatgctgcgcccccggatcgggcagcggttcccacgacggtgccaatattcccgccaagcggcgtacggaaaatcttgcaggctccgtcacggagctgacgccgataggctctgccgttttccattcaagctcccgcttgactttacagactgcgatattgacatgtcgttttattgctaaggattttgccgcaacagctgccataacccccccatattcgctggcgcgcgacataccgtagcccggggctccacttcccaacaagatcgaatcgagccgttttaacctttcttggtgaaggagttcagggcggcaagcccggtacatcccgggcgttgctccactgcttcggttcacgactgttcaacagcccggaaccaccgtgtggcacccggagggggagtcgataaagcgcgatcccgggggtacacggtggcctgtaccggtttgacctgcagtgaccgttgaagccggtacgtgcggcggacggactcacgactcgcgccgcggcggccgaccccttcggaactactgggagcctctctttcgacgccgcctatttccggcggatcgcctttacttcggcacccgcacgacggtcgtgtacgtgtggttggtcaccatctcgaattccgggtccaggagtttctcccggattacggagaggtcggcttcggtcagagatgtctgactcagcaggaaaggctccagcatggtgctgtgcagtcgggcgagccgcgcggtcggcgccccgccctcccccggtgcccggaagtcgcgcaccgtgatgtcccgatagccggcggcggacagaacgtccggcgtacgcgccgcccattcgaaatccataccggtttctccggcgagtttgtgcacgccgtcgtggtattcctggaagatgcgcgccgtgtatgcgtcgaccggggacttgatgatgccctcgtcagcacaaccgcagtaccagtcggtgagcaccagcgcaccgcccggccggagatgtgcggccagcctcgccgcgaccgcttccttgtcggccacgtgcatcagcaccagccgggcgtgaatgagatcgaacgcgtgctccggccacgggtcctcgacgaggtcgtggcggatcgcctcgatccgcggatggctgggtacgtgctggggcttgaggtcgctggccaccacatgtccggacgtccccaccctggcggccagccagcgggcgacggagccgtccccggcgcccacctcccagcaacgccacccatgcccgacgcgtacctcctcacccagggtgcggaaggtctccctgttgaggatctcggagagcaggccgagctgctcgggtgcttccggcgcgccgttgtcgaagcgttgctcgtgctctgttctgtacatggtcttctccttggtgagccgtccacgccaccggccccgcagctagatcgacgcgggcagcagctcgttgaccagttcgacgaactgcttcggggtcgagttcttgctcgccttgtcgtcatcgggcaggccgatgccgagttcacgctcgaccaggagcgtcacctccaccatcgcgaccgagtcatagcccatatcggcgaacgtgatgtcggcgatatcgccgtccaggtcgaatccctcgtcctcgccggccgcctggcgtatgtaccccaccaggtccgcctgagtgaaagtcgccattgtcgatcccttcgtctcgtgacgtcgaaaccaacatcgccgggaggcttcgacacccagtcgagtttcggtcgacggaggctcccggtattcggcctcgggaccgtcgggatgcgcgcaccgcggcacggcctctcgtacgcaccacggcgaggcctcgcctgggcctcgaacgagtctccgccggacatgacgaccatgaccggataggggaaacccgaggcaatccgatccgtgggaggaagaagatgagcgacggactctacatcgccgccgcgagttcgtggctgcccgagcggctgacactcgacgaggcggagcaggccggcctcgccgatcgggcgcgggtctggaacaccggcatcgagtcggtgtgcgtctcgccggacaagtcggcgccggaaatggcggtgctggcggcacgggacgccctcgggcgcgccgcggtcggggcggaggacctgcagctgctgctgcacgcctgcgcgtaccaccaaggtcatgacatgtggccggcggcgtcgtacgtccagcgcttctgcggcggtggctcctacccggccgtcgaggtccgccagatgtccaacggcggcatgatcgccctggaactcgcggccggccacctgcgcgcgtacggcgggtcgaccgccctggtcaccacggccgaccggttcagcctgcccggcttcgaccggtggcgcagcgacccgagcaccatctgcggcgacggcggcaccgcggtggtggtgtccacccgcaccggcttcgccctgctccgcggactcgctacggtgtcggatcccgggctggagcacggcagccggggcgagcggttcagtgacgcgccgttggccgcgcgagcgccgatcgacctgaacagcgactccctggtgcgcgaactcggagtggaggccctgctcaaccgcatcgaagcggggcaacgggaggcgttcgaccgggcctgtgcccaggcggacgtcaaactcggcgacatcgactggtacgtgctgccgaacctgggccggacccggatgcgggcgcagtacttcgacccgttcggcatcgatccgcagcgctcgacctggtcctggggccggcgggtcgggcacctcggcgcgggcgaccagttcgccggtctcgcccatctcgtctccgagggcgcactggagccggggcagacgtgcctgctggcaggcgtcggcgccggcttcacctggacggccggcatcctggagatcatcgccaggccgtgagccggaggacaccgtgtcgaggtgcccgcgtcaccagcgggtgcctcgtccggggcgacgccggtggcagccgtcatggacggctgccaccggcgttcgtcatgccgccgtcagcaccaccgcggagttgatgccgtcgctgcgggccagtaccagagcggtggacacggtcgtctccctcggtcggtcgagcaccaggtcgagctggtcggaccggacggggtcggtcacattgatcatcggcgggatgacgccgtgccgcatgctcaacgacgccgtggccacgtcgagcgccgggccaccggagtacagccggccggtcatcgtcttcggcgcggtcaccggaacaccccgtggaccgaacacggcggtgacggcggcggcttccgcgcggtcgagttcgccgaccccggccgcgtccgcgaacacgacgtcgacctcgtcgggcgtcacaccggcgtccgccagcgcggactcgatcgcccggcgcagcccgggctcccgtgccgaaccgggccgcgggtcgaaggtggtggcgtacccggcgatctcgctgtacggccgggcgcctcggccgcgcgcgtgtccggcctcctcgacgacgaccatggcgccgccctctccgggtacgtagccggacgcggcggtgtcgaacggcaggtaggcctgggtccggtcggcgaccgtgctcatccggccggtggtcagctcgatcgtccacccgagcgggcacatcgcgctctccacggcgccgcacatcaccaccggcaggccgtcgaccacgtgccggcgggcctgcgctatggcgtccaggccgctggtgttcccggtcaggacgccgccggggccgtgccacccgtgccggatggaaatctgacccgtgttcaccgcgtagaaccacgagaacgagagataggcgctcacatggtcgctgccgaggctccagagcttctccagctcgcgctggctgtactcgaggccgcccgcggagagaccggtgacgatgccgacctggtcctccgggagcgcggccggatcgagcgaggagtcccggacagcggcgtccgccgccatcagcaccagccgggtggtctggtcggtctgcggcaccagacgtccggggatgtacgcgcgcacgtcgtagtcggccacctcgcccgccagtgtggccgggtactgctccggatcgaagcgggtgacccggtcgatgccgccccgcccatggaggacggcgtcccagtactcgtcggtgtcgaacccgttcggcgcgaccaccccgagaccggtgatcaccgcacgaggacgctccggcgtcgtgccgttgtcgttctccgggactgccctactcatcggatcccccctgggtcagcaccatggcgctctggaaaccgccgaacccgctgccgaccttgagcaccgtccgcaggtccgcctgtcgcgccgacagcggcacgtagtcgagccccagttccgggtcgggttcgtgcaggttggcggtcggcggaatgagcccggcgtcgatggccagcgcgcatgccgcgatctcgatcgagccgatcgcgcccagcgagtgcccgatcatggacttgatcgaactgaccggcgtccggtaggcgtggtcgccgagagtgcgcttgaacgcgtcggtctcgtgcgcgtcgttctgcttcgtaccggagccgtgcgcgttcacgtagtcgacctgctcgggcacccgcccggccatccgcagcgccacctcgatggccttggccagttccgggccctcggtcctgagtccggtcatgtggtacgcgttggcgcgcacgtcccatccgccgatctccgcgtagacgcgcgcgccgcgttccctggcgtggttcagctcttccagcaccagcatcgcgctgccttcggcgagcacgaagccgttccgggtgcggtcgaacgggcgggacgcggtggccggttcgtcgttgcgcggcgtcgtcgccttgatcgcgtcgaagcaggcgacgcagatcggtgagagggacgcgtccgagccgccggccagcatcacgtcggcggagccctcgcggatcagccgcgccgcgtgggacaccgactcgatgcccgcggtgcatcccgtggacaccagggacacggggccttccgccccgaccgtccaggccacgtccgcggcgatcgacgtcgggacgagatagttgtacatgtgcggcaccgcgtactcgtggtcaaggagccacttgcggccgccgtcggagagcacgttgtactcccggtccaggctcatcgtgccgccgatggcgctgccgacgctgaccccgcagcgatgcgggtccgtctcggccaggtcgagtccggcgtccgcgacggcttccctggtcgcggcgacggcgagctgcgcgctccggtccatgcgccggatctcctgcgcggagaagccctccgcgaccgggtcgaaatcgcactcgcccgcgatccgggagcggaacccggacgcgtcgaagagcgagatggtgcgtatggccgaggtgccggaggagatcagctcccagaactccttggcgtttcctccgcccggggcgcgcactccgatacccgtgatggcgatccggcgggtcatcgtgccctcaccgctcgcgcgctgactgctgtattcggcatgtgggtctcttttctgatgacggtccatggcgagaaagcggaatcgtcgatgccggggtcaggcatcgaaggtgaccggcagggcttccagtcctcggaccgtgaggctccgctgccatcgcaactgctccggcggtacggacagcgcaaggccgggcagccggcgcagcagtccgtggaacgcgatccggccctccagccgggccaggggagcaccgaggcagaagtgcgcaccccgcccgaaggccacgtgggcggggtccgcgcgggtgacgtcgaagtcgtccggtgccgggaacttcgccccgtcccggttggccgatgccagggacaggagcaccgggtggcccttctcgatgcgcgtgcccgccacctcgatgggttcgagcgggaaccgccacgtcgccgtctcgaacgacccgtcgtaccgcagcatctcctccagcgccgagtccaccagttccggtcgctcgcgcagcagggcgagttggtcggggtggcgcagcagggccagggtgccgttgccgatcagattgaccgtcgtctcgaagccgccgaccagcagcagggacatcatggacagcaactcggcctcgttcagccggtcgtcgtcgtcccgggccgcgatcagcgcgtcgaccagtccgtcggccgggtcctgacggcgcttgtcgaccagtcgggtcagatattcgaggaggtcgcgcagtccgaccggccgcgcgtcaccgcggtcggcctgggcggagtcggtgttcgtccaccgccggaagtccttcgtccactggcggaacacgtcctggtccgccttgggcactcccagcagttcacagatcaccgtgatcgccagcgggaacgcgaagtcgccgatcagctcggcctgcccgcggggcacgatcgtgtcgaggagcccgtccgtgatgtgctgcacctgtgcgcgcaggccctcgacgcggcgggcggtgaaggcggtcgagaccagccgacgcagccgcgtgtgttcgggcgcgtccgtggtcagcagatgcgtcccgagcccggtccggtcctccagcggtctccccttgcccgcctcctgccagtcgagcggtgcgttgcgcgggtccttgctcatccggggatcggacagcagcttccgcacgtcctcgtaccgggtcaccagcagtccgtaaaggccgcggccctccaggacctgccggaccggttcctccgcacgtaaccacgcgtactcgggatagggatcagcgccgaaatccatcctccgcctcctctgcctcggtgttcggttcctgaccggcctcgcgtcccacccggacctgatccctgccggcccggccttcaccatcacgcggggaacatccgcgaacaggacgcgccgagcgcgcgttcgctcgaggtcggtggtcgagggaccacatggcgccgatgctcgcggcagcggttcgaggcgagttcgtgtgtggttcgacccaaggaggggggcgtacggaggcggcccggggcgcctcccggcgccgagacagcatgcggccgacaccgaccgtgccggtgtcgaccgcatgccaggggtacggatccgcgtcaggccttctgccggcacaggatccggtcgaggacgtcccgcaggtgctgcgtgctggtctccacggcattccgtgtcgtggccgtacgccagccgacgaacccgtccgggcggacgagcacggcgccgtcctccttgatgccgacggcctcggcccacccttcgaccgcgtgccccgtgatgcccaggtcccgtgtcgcgtccagccagtggtcggccgcggtcccggtgatcagcgtgaatccgtcgacgaggtcgaccgtggaccgtccgtccggaagccaccggtgcggcaggcggctgcccggggcgccgtccaggacgaggttctccatgtcggagagcggctccgggtcgaccaccgcgccggagtcgtaccggtagccgatcacggggatcatgatgcccgccatgcccacggccgcgcggtcggcggcccggctcgcgtcgttgtcccagtgcaggtcacggtgctcggcgcggagcacggtctgtcgcatggtgaacagcgcgacgggccggcgctcggcctcgtaggtgtcgagcagcgcgtcaccgccggcggccagtttccacgccaggttgtggccgtcggcgatacccacgttgagtccgagacccccgaccggcggcaccacgtgggccgcgtcacccacgaggaagacgttgccctgccggaagcggtcggcgacccgcgccgtcgacgaccagggcagcaggctgatgatctccggctcgatgtcgctgacgccggtggcgtccctgatctgctgctggatccgctcgacgggggtctccgggtcaccgttcgggatgtggaagacccagcggccggtctcgtcgaccttcagcaggatcccggacgcccgctcgttgcgcaggaacgtcatggacgtcggcggggtgggcagttccgcgcggaacagcacgttgagcatgtgcgaactgctcagcggtcccgggccggtcacgccgatgccgagcaggtcacgcatccggctgcggactccgtcggcggcgatcacgtagtccgccgtgacggtcctgccgtccgcggtggtgacgccgccgtccgtcaccgcgaccacctcgctgtcgaagtccacctggccgccgagctcccgcagccgtgccagcgcggcccggtcgacccggtcctgcgggcagcttcccagcttcgccgggccgatctccggcggctcgaacttggccgtgacggtggtcagatcggccaggctcgtgcccgtcatgaggccccggacgagatggtccgtctctatgtcgatgccggcctcccggaggatctccgccgaccggtccgtgatgccgaaggcccgcggatggtcgttgacctgtgcccggcgctccagcacatggaccgagacaccctgacgggcgaggaagacggcggtgcacaacccgaccgtgccgcctccgacgatcactacgcgcatgcttgtccctccgagaatgagaacggtgttttcctcacgggtacgtcgcacccgtggcggtactggagacgcctccgctcacccgccgcgtccccgggcgggagacgcgcgtacggatctagagtccggcgcgggcgaagcggcgcaccgagagcggcacgaagatcagcaacagcaggccggcccacagcaggctcgcggtcaccgggtgggtcagcggccacgcggcgtccggcccgggagcaccggggttgccgaagagctcgcgcgcggccgccgcggcggagctgagcgggttccactcgcacagcgcccggaggccgaccggcatccggtcggtcggcacgagggcgttggacaccatggtgagcgacagcgtgagcggtgccagccgggccgcggtccgtgccgaacgcaccacaaggcccaggtaggtgccgacccacgccagcgtgtagcggaacagcaggagcaggccgatgccggccagcgcccgcggaacgccgtcgtgcggccgccagccgacgacgagaccgcacaccatcaggaccgcgaggccgtaggccccgaggatcccctcggcgccgctctggccgagcggcacggacacccggtgggtcgggagcgaacgcaggcgctccatcaccccgcgcgcctggtccgtcgccacctccaccatggcggtggacagagcggtcccggtcgtcatcacgaacaggccgggcatcatgaactcgcggtagttcgaggtgcccggcaccccgatcgcgccgccgaacacgaagccgaacagcaccacgaacccgctcggcatcatcagcatggtgagcagggtgccgggctcgtggcgcagccggaacagccttcgctgggtcagcgtccagccgtcggccaggaggttcacgacaccgcctcgggcgtctcgaccggttgcgccggtccgacggtctgcccggtcatcgtcaggaagacgtcgtccaagccgggctcgcggatcccgatgttcctgatcaccgcgccggacgcgtccagttcactcacgatcagcggcagggcgggcgcctgatccaccgcggccacgacgatgcgcgatccgtcggcctcggggcaccggccggtcagccgctccagcctcgccatggcactcggcacatggtccgccgactcaaccacgacgtcgatgtgacggccgatctgggctttgagctgggccgggctgccttcggcgatcagctggccgcggtcgatcacgccgaccgccgtggcgagccgctccacctcctccagacacggggtggtgagcaggaccgtggtgccgtcggccaccagtctccgcacgctctcccagatctcggcgcgactgggggcgtcgagcccggtggtcggctcgtcgaggaaaagcaccgcgggggcccgtaacagactggcgatcaggtggatccggcggcgcatgccaccggagtacgtgccgaccagccgatcaccggcgtgggcgagaccgaaccgttccagcagctcgtcggcgcgccgacgggcgccgcgcgagccgagccgcgagaggcggccgaggatccgcaggttctcccggccggtcagtccgtcgtcgaacgaggcgtcctgaccggccaggccgatcaccttccgcacatccgccggattccgggccacgtcgaagccggcgacgacggcccgcccgctgctgggccgggtcagggtggccaagatccgcacggcggtgctcttccccgcacccttcgggccgagcaggccgtagacggtgcgcgacggcaccaccaggtccaggccgtccagcgcgacgacatccccgtactgcttcctcacatcctcggtgtacatgatcgcgtcttccatgcatcaacccttcaccgagtacggtgtacgcgattttagcgtagccaaccgagtgcgccgtacgcaactttgcgtcggacgcgtaggatgactgtcgtgtcggactcgaacccaatcatctggatgcgaccggagaagccggcgcgaggccccgcgccgtcgcacagtcgtaggcagatcgccgcggtggcgatcgatatcgcggactccgaaggcatcgaagccgcgtcggtgcgcgccatcgccaagcgactcggcaccggtgcgatgaccctctaccgctacctgccgaccaaggaagacctgtacacggtcatgatcgacgaggcgaccggcttcgagccgcaggagccgaccggcgatctccgtgcggatctgacgaccttggcacgccgccgccggcagatcctcctgcggcacctctggctcgccccgctcctcgccacccgcccgatcatgggccccaacttcatgcgcggcatggaacgcgatctcgccgttctcgccggctgcggcctgggcatggacgacacgatccacgtgctcaacctgatccactcgtgggtcagcggcgccgtgcaggccgagttgaccgagcgggcgaccgcgaatcagtccggcctcgaccgccatgcctggcggctgcggatggagccgtacctcaagtccctgctggagaccggtgagttcccgcacctgagccggatggtccagacctccgagatcggggaggcagacgagcggttcgcgaacggcctggcgatcatcctggacggaatcgaagcccgcttcccgacggccaccgggaaggacggatcgcgccggccggtcggcgacaccggcggtggtgcgccgtcggcgcggcgcgcgaaaggtcagccaaccgcgcgcagttcgacgacggagtaacggccggccggcgtgaccgaggtggtgtgcaggccgacggttcccgccagttcggccagttgctccagggtgtgctgccggccgccgaagtagccgagcatgcgcaggtcgccctccgtctgcacggtccggtcgccgaagtagtccacgacgagcacacgtcccgtcgtctgcgccgcgtcggcgcagcggcgcaggatacgggcggccgacgcgtcgtcccagttgtgcaggatgctcgacagcagatatccgtccgctccggcgggaagagcgtcgaagaaactgccggccgcgatgtcggcccggtggtcgagaccggccgcggcgatggccttctcggcgcggcgcaccgggccgggcaggtcgacgaccgtccccctcaggtcggggtgggactgcaggatggcgatcagcatggtgccgtcgccaccgccgacatcgaccacatgacggagcgttccccacggatacgccccggccacggccggcgagtgcgccgtcaacctggcgcccatcaaggtgtcgaaggactcggcgcgcccgtcgtcggacgacaggtcgtcccagaacgtcacaccgtactgctgcgggaacgcggcctcacccgtgcgtaccgtgtgcaacaggtggacgaggctcaactctgcgtgtcccagggcgccttcgatgtcgagtatggcccgcatgtcctcgggcgcgccctcgcacaggtggcggcccatggccgtcaggtcgtaggcgccgggcccggtgcccgacagcacgcccgcggtcaccaggtggtccagcagccgccccagcgcgtcccggtcggcgccgacggcctcggccagcgcctcggtcgtccgggcgcccgcggcgatgtggtcggccagccgcaacgtcgccgccacccggacggccatcggggtcagcagatcggcggctgcccacactcccccgcctcggggggtcgtctccttggccatgacttctcctgactcgacggttctctgttcgtgggacccggccgggacggtgtcggtgccggtgcggcagctcacgtccggccgggcggttcctcgcccctcgcgctgtggcgaggtctctcggaggccggtgcggccgactcagaagccggcgcgctcctccgcgtacgccttggcgaggcggaggttgctcatgctgttgccgctcagcagccgtcgcaggtaccggcgcgcctcggcgaccgtcgtcgcgccgcccagctgggacagcgccgagcgcttgatcgtgctggtgtgccgggcctcggcgatgacgccttccggcgtctcggtgaaccgccagtggccggtgtgcgcgtccagcatcgtgggcagcgagatctgcttgtacacgatcaggtggttcgggaggcagatccgcaccgagcggacggtgtgcgtgctgccgtccggacccttggtgtccatgtcgaagaactggacgttcggcacgtcctcggtcatggcgagccccaccacgtgcgggatgcgctcgggccacaggtccgcccggtagaggtagtcataggcgtcctcgacggagccggcgatgaacagcgggtcagtgaaggacacgacgagttcgtccaggtcggcccggcgctcggccgtgtcgcggagcgtggcgaggcagtcctcgctctcctgcgcgatcctgtccagcaacgggccgagatcggcgccggtcggcgcgacgacctggtggctcagctcgacccgggtccggttcggcgtcagttcggtgaagacccactcgccgcggaggtcggtggcgggctgttcgggttccatgtgcgcgaaggtgatgcggcgccccggccggtccgtgcggcgcacggtctgccaggcgcggacggcggcgtcaccggccagagcccagtgcctgaccaactctcccttctcgttggcgtggaccgtctccgcgtgcaccgcggaccggtggaactgcggccatcgcgcgatgtccgcgatcaggtcgaacaccgtctccacgtcgccctcgatggtgatggcgtggtcaactcgccgctgtgtactcgacacaacaagacacctcacaagcgtcgtcacatccgtatccgtcgcgaccgacgatgtccgtcctcgatcgacctcgcttcgaggacccttcgagttccccgtccgcggtcggccccggccgttgaccgggcgtcgatccggcgtcgaaggcgcgggcgcaagctgggcgcacccccgaaacgcaccccgcctattcgtaaggagacgctaaatgccgagcatcatcactgtcggcgcattcgacagtggtaacgtcgccgacgtcaccaagatccttcaggagttcgatggcgaggtcgcgtccgaactgccccagctgcgccgccgccaggtattcagctacagcgacctttatgtgcacatgcaggactgggacgtcgccgaccccgacgaggcataccggatcatcagcaccgacccccggtgcacgcggctgaacgaacgcctgtcgacctatttcggcgatcacgccgcgacggaggactgggacggcccggtcgaccggccgacggccgagcgtttctacctgtggccggccgagcgactggacgacctggagcagacgtacagcgcggtgatcgtcaacacccagcggcaggaacacatccccgaggcggcacggctgttcgcggagtcggacgcgaccgacatcccgcagaagatgggcacgctgcgccgccagatctatctgtggcgcggcatctacctgcacatccaggacttcgccgtagccaacagcatggaggcgatcagcgaggtgtggacggaaggcgatccccgcttcctccagctcgtcgacgacctcacggagatcattccgccgtacgacccgcagggcaattcactggccacccgtttctaccactgggctgcagaggtgccggcatgacgaaactcccgacccaccccattcgccggcagctccccggcgtgctgccggccgagtacgagacactgcgggaacgaggcatcggccaggtcgaattgcccacgggcaaactcgtctggatggtggtgaggccggaatacgcccgcatcgtgctctccgacccgcggttcagctcggacaagacggacgaccgatttccgaagctgacacccaattcgctgatgaagctgcggtactgcgcaccgttcatgatcaacctggacggtccggaacacctgaagaagaagaagtccatcatggacgagttctccccggaaggactcgcccggctgctgccgcgcctgcgggtcgccgtcgaggagaagatcgacgacatgctgcggcagccgacgaagccggtcgacctggtgaaggagctggcgttccccatcgcgtggcagctgcaggagatgttcctcggcatccccgcggccgagctggagacgatgcgggacaacgtctggaagctgctgctcggcaccaccaccgaggccgaggagagggaagcggccgaccgcctgaacgggcacgcggaagaggtcctgaaggagaaggccaagcacctcggcgacgacatgatgagtcgtctgatcgtgcaggaacgcgagaagcacggcgaggtcaactggtacgaactcgcgcctctgatgctgtcgaacgcccagggcattcacaactcggtgtccacgatgatctcgctgggcgtgctcaccctgctgaaccacccggagcagcggccgacgctgctcgcccatccggaccggatgacgactgcggtggacgagatgctgcggtacttctcggtcaacgacggaacccccatgcggctcgccaccgaggacatgctcatcggcgacacgctggtcaaggccggtgacggcgtggcggtgccgacgctgcccgtcaaccgcgacccgtcggtgtgcccgtatccccatcagctcgacatcatgcgggaggagcccgcccggcacctggcgttcggtcacggaccgcacaagtgtccggcggaccgcctggtgccgagcctgctcgagatcgtctacacgacgctcttcgagcgggtcccgacgctcgcgctcgccgtgcccgaggcggaactgacgtacaagtaccactcgatccaggcgttcggcccggccgagatgccggtcacctggtagccgcgcaggccgccgcgctcatcggcgacgggcgtggccgccgcggagcgcggcggccacgcgggcccaggaccgaccgagagaaatgacaacctcgggttgacaccacccgactgacaacctacggttgacaccatgacgcagatcactccgccggtcaagctcgacgagctcatcacggcgatcaccgagaaccacaccaccgccctcgaccagctcagcggcgccatcctgctggccgaccacatcggcgaggtcgccgaccatctcatcggccacttcgtcgaccaggcccgtcactccggcgcgtcctggaccgacatcggccgctgcatgggcgtcacccggcaggcagcccagaagcggttcgtcggcaagcccgacgccaagccgtcgaatgccttcgagaagttctcccagcccgcccgcagcgcgatcatcgccggcatgaacgaggccaagacggccggcaacgccgagatcgtcccggcgcatgtcctcctcggcctgctcggcaccgagggcagtgcggtcggcgccctgcgggcgcagggcatcgacctcgaccaggcgcgagacacggcggtggccaccctgccgccgcgcagtgacgccgatccggtgctgatcccgtacgacgcccacgcgaagaaggcgctggaactggcgtctcgggtggccttccgcctcggccaggacagcgtcagcaccggccacatgctgctggggcttctggaagagggggacggcgccggggtgctggcctcgctgggcctcgacacggcagcggccgagcgtttcgtggcggaagccgccgacgaatcgtccgtcgcctcgtagcgaaaccgaccgcgtccgtccgcggacgtcggctgacagcgtcggactcccggaatgggaacggcacgggaaccgaacggttacggaacgggagctccgggcgaggtggaacctgtcaagaggtgacaccccgcccggttgtcctcgcgccccgctccgaccccctaccggactcggcccgtcgcgccctgtgcgctgtgaaccgcctacccgggtgcgatggcggccggacctcccgcggaggatcggatcccgtccccctttcccgaccccgtacatgcggagtggtgtgatgactttcgaccggacgcggatcttcggccttcggcgcctacggagggcacgtcaacgcaagaccgagatgggaagcctcgcaccggcggcctccctgaccgcgccgcgccggccagccggcgcgcgtgcgggagcgcctgtctgatggcgacgccgggtaccgacggccgtgtcgctctcgtcaccggcgcttcgggagcgctcggcgccgccgtggcacgggtcctcgaccaccgtggctaccggctggcgttgcactacaccaacggtgaggaccaggcccgcaaggtagcggccaagctcagcgggccgagcaccctcgtgcgggcggacgtcgccgactgggctgccacccgggacatggtcgaccgggtacgcgctgagctgggaggcatcagcgtcctcgtcaacacgggtgcgatccgccgggacggtctcatggccacccagtccgtcgacgactggacccggaccgtcgccgtcaatctgatcggcaccttccatacctgccgggcggcactcccggacatgctgcggggccgctggggacgcatcatcaacgtcgtctcgcccgccggcctcctcggcagccggggccagacggcgtactcggcgtccaaggccggtgtgctggggatgacccggagcctggccctggagtgcgggcggttcaatgtgacggtcaacgcgctgtcacccggcctgatggccaccgcgctcaccgaggaggtgccggccgaggtccgcgccacgctcgtggcgcggaccgcgttcggccgcatgggcacgcccgacgaggtggcccgtggcatcgaactgctgctggacgccgactacatgaccggtcaggtgctgtccatcgacgggggcatgtcgatctcgtgaccgccgtgccggacggccaccccgcgcgccccgctggaggagttccccggagccttccgcgtgcgaagtcccgtcaccggcaccggacctgactgcggaggcacaagcatcccctccagccggtactgaagcgaggaaggatcacgacacgaccaaccctcgccgcatcgtcatcggaagctcggtccgaatggccacgcagggccgctccgtgtgcacgcggccggaagatgatgccccatcaggagcttgatccggcaattcggcatggtgcgtaccgcacaccgttcagtccttcacccatcggctggacatcacgctgtcccctcaggaagaggcgctcatcgccagagccgtcccgaaacggcgcaacgagttcaccaccgtccgcgcctgcgtccacgccgagcccaactccccgcttgcggaaggggtactggaggccataacccgtcccgaggaacgctccgccctggcctcacttgccgccctggccgccgcggcggccaggcccgcatgggaccccgcctcctgttcagcgccaaggtgtccgtacacaaggcgtggtacccggtgacccgccgccgactggacttccaggaggcgttcctcgacctcgccccagacggcacgttcaccgcccgcgccctcgtacccgccccgcccgaactcgcctgtgtacacggacgttgggtcgccgacagcagccatgtgctcagctggacagcagccaccgtgaacgcctcgacccactgaacacgccacccgtgtgacgccccactgagcgtcacgggacgtcagcaccgagaggcgcgcggacggggtcgaccaaggcttggcgactggtccacaccccttcaagatgcccaccgtcacacgcgtgagcgcttcccccggcggccaacaattgcgcatgacgaaccgtcaggaatcgcgccgttcgtgcgtcaagcgtgcgtcatgtgcgtcgaacatgcgtcaagatatcgcacctaacgcacctaacgcccatcacgcacactcagagaaacggcaggtcagagcccctttgcagcaggctccagaatcgccacacactccacatgatgcgtcatcggaaacagatcgaacgcccgcagcgtccgcaccttgtagccgccgtcgcggaagtacccgaggtcccgtgccagcgccgccgggtcgcaggccacgtacgcgatctttcgcgcgcccagggacacgagctgttcgaccgtcttcttgcccgcgcccgcacgcggcgggtcgaggacgatcaaatcgacctcggtgatgccggtgcgcgggaggaccgcctcgaccttgccctgttcgatgcgcacgcgctcgaaggcggcgaggttgtgccgcgcgtcctcgaccgcgcgcttgccggactcgatgccgagcaccgcgcccttgtcaccgagccggtccgcgagcgcgcccgcgaagaggccgacaccgcagtacaggtcgagcgccatatcgcccttgcgcggcagcagaccctgcatgacggccttgaccagggtgtcggcggccatcgggtggacctgccagaagccgccactgccgacacggtaggtgcggccgtcggcgcgctcacgcacgaacgcccggccgtggacgcggtggatgccgccgtccttctcctcgacgcgcatgacggagacgggcttgtcgagctcgacgaggggcagacgggcgccgggccggggctccaggatcaccatgcggtcctgcgatcccgtcgccgcgatcgcgtcgaccgactccatgccggaccagtcacgctcctcgatgcccagctcgctgacgcccggtgccgcgatcatgcagtgctcgatcggctcgacctcgtgcgagcggtggcgccgcagcccggcgttgccgtcggcgtccaccgcgtactgcacgcgggtccgccacgcggggacctcgccggccgggagcttgtcgccctcggcgggcatcaccgtgccgtcccagcccgcttcctcgggcgtgaggcccgcgagccgctgcaactgctcggcgatgacctcgcccttcagtcggcgctgggcgcccggcttggcgtgctgccagtcgcagccgccgcagcggccggggcccgcgtacggacagggggcctcgacacggtccttcgaggcgtccaggatctcgacggcgtccgcacgcaggtaccgcgcgccctcctcgccctcggtgacgcgcgcgaggacccgctcgccgggcagcgcgtgccgtacgaagaggacctggccctcggatgtacgggcgatgcagtgcccgccgtgggcgacggggccgatctcgacctcgtactcctcccccaccagcgacttcttcggttctgcctgcatggtggggtgactccagtaacgagaggggggaacggccggacaacagcccaccagtctacgtggacaccacccggccgctcaccacgagcccgtcagcccttcgtgttcgacgactccttcgcgcgctcctccgcgggcccgcgccgcaccgcacccggcgcactccactcctgccgcctgcgcgcccgcttcttcgcggcctcggaggactccagctggtagggcacggaggtgaccatgacgcccggggtgaagagcagccggcccttcaggcgcagcgcgctctggttgtgcagcaggtgctcgtaccagtggcccaccacgtactcggggatgatcacggacaccgcgtcgcgcggcgactccttgcgcagccccttcacgtactcgatgacgggccgggtgatctcgcggtacggggagtcgaggaccttcagcggtacgtcgatgccgcgccggtcccactcctccttcagtgccttggtctcggccgggtcgacgttcacgctgagcgcctccagcgtgtcggagcgcatcagcttggcgtaggcgagggcgcgcagcgtcggccggtggatcttggagatcaggaccacggagtggacgcgggaggggcggacactgtcgtcggacgggccctcgggggcggcgatctcctcggcgacccggtcgtagtgcttacggatcgcgctcatcgtcgcgtagaagatgcacatgccgagcagcgcgacccaggcgccgtgcgtgaacttggtgacgaggacgacgaccagcacgagcccggtgaagaacgcgccgaacgcgttgatcgcccgggagcggaccatgtgccggcgcttggcctggtccttctcggtggccaggtggcggttccagtgccggaccatgccggtctggctcagcgtgaaggagacgaagacgccgacgatgtacagctggatcagccgcgtcgagtcggcgccgtagatgacgaccaggagggtcgccgcgcccgcgagcagcacgatgccgttggagaaggccaggcggtcgccacgggtgtgcagctgacgcggcagatagcggtcctgggcgaggatcgagccgagcagcgggaagccgttgtacgcggtgttcgcggcgaggaacagcaccagcgcggtggccgcggccagcacgatgaacaggaagctgcccttgccgaagacggcctcggcgacctgcgagatcaccgggttctgaacgtagtcggggccgaccgcgacgccgttgtggatcaggtcgttcgccgggttctccgccatgcggacgttggtcgccatggccagggcgatgatgccgcagaacatggtgacggcgagcaggcccatcgccgcgagcgtggacgccgcgttcttggacttgggcttgcggaaggccgggacaccgttggagatcgcctcgacaccggtgagcgcggcacagccggaggagaaggcgcgcagcagcaggaacacgagggcgaagccggcgaggccctggtgctcggccttgatgtggtagtcggcggtcggcgcgtgcatggtgtcgtcgaggacgaacccgcggaaggcgccccaggcgatcatgatgaagacgcccgcgacgaagacgtacgtcggaatcgcgaaaagttttccggactcctttacgccgcgcaggttcatcaacgtgagcagcacgatgacggccaccgcgcaggagaccttgtgctcgaccacgaaggggatggccgagccgaggttctcgatgccggaggcgatggagacggcgacggtgaggacgtagtcgacgagcagcgcgctggcgacggtgagacccgccctggggccgaggttggtgttggccacctcgtagtcgccgccgccgctcgggtaggcgtggacgttctgccggtaggaggcgaccacggtgaacatcagcaccacgaccgcgaccgcgatccaggggctgaagtggtacgccgacacgcccgcgatggagaggaccagcagcacttctcctggtgcgtacgccacggaggagagcgggtcggaagcgaagacgggcagtgcgatgcgcttcggcaggagcgtttctccgagccggtcactgcgcagtgcgcgcccgatcaggatccgtttgggcacgtcggtcagtttggacacgcagaggatcgtaagcgttcgaacgggaggtcgcccacccgccgtcccgcatcggcccgccaaccgtcgcccatctgctctccgagtgaaatcgcagaggcgtcacgctgcggattccgcacctacggcgatccccatgcctatatgacaaaacctcgctcattgcaccccacggaggtcccatgcatgcgcccgcggagctgatcggcgccgccgccggactcgtcggcctcggaatcctgacccttctcagcgtccgcagcatcggccgccgctgaccatgagaacccgcaggcgaatgtgcacgggggtgccgtccgcggaccgcacgtgtgtagcttgggcggcggtctgagaccctgttgttggcgtttcgactgagccgtgaccattgacaccggaaggacggtcgtgcacatcgtcatcatgggctgcggaagagtgggctccgctcttgcccagaccctggagcaacaggggcatacggtcgctgtgatcgaccaggaccccaccgccttccgacgactgggctccgggttcggcggccgtcgtgtcaccggagtcggcttcgaccaggacaccctgcgcgaggcgggcatcgaggaggccggcgcgttcgccgccgtctccagcggtgacaactcgaacatcatcgcggcccgggtggcccgcgagatgttcggcatcgagaacgtcgcagcccgtatctacgacccgcgccgcgccgaggtctaccagcgcctcggcattccgacggtcgccaccgtccgctggacggccgaccagatgctgcgccggctgctgccctcgggcgccgagccgctgtggcgcgaccccaccggcggggtgcagctcgccgaggtgcacgcctcttcggcctgggtgggccacaagatcagcaagctccaggaggagaccagcgtacgcgtggccttcctcacccggctgggcgaggcaatactgccgtcctcccagacggtgctccaggagggcgacctggtgcacgtgatgatgcgtacggacgacgtcgagaaggtcgaggcggcgttcgccgagggccctgaagaggagagcggtcactgatgagggtcgccattgccggtgccggtgccgtcggccgctcgatcgcgggcgaactgctcgagaacggccacgagatcctgctgatcgacaaggcgccgaccgccatctcggtcgagcgcgtcccgcaggcggagtggctgctcgccgacgcctgcgagatcacgtccctggacgaggcggcgctccagcgctgcaacgtggtgatcgccgcgacgggcgacgacaaggtgaacctggtcgtctcgctcctggcgaagacggagtacggcgttccgcgcgtcgtcgcccgcgtcaacaacccgaagaacgagtggttgttcaacgaggcctggggcgtggacgtcgccgtctccaccccgcgtctgatgtcggccctggtcgaggaggcggtgagcgtcggtgacctggtccggctgctgcgcttcagccacggcgacgcgaacctggtcgagctgaccctgccgccggagtcggccctggcgggcacgcaggtcggagacgtggagtggccacaggacacgtccctggtgacgatcatccgcggcacccgcgtcctcacaccgtcccaggaggactccctggaggcgggcgacgaactcctgttcgtggccgcgcaggcccgcgaggaacaactggaggacctgctgtcggtgcgccgcgaggacgcatcgagctagtgccgcaacaggcaacgtgcgccgcgatacgacgtcgggggcgcccggagatctccgggcgcccccgactcgtacgggtgaccaggcctgacgcactcgctcgtacgagtgaccaggcccaaaaacgaactcaaacgggtgactagacgtcgcggcggtgacgccctgccgtggcctcgccccgctcctcgccccgctcctcggccagtgccgccttgcgttcctcctcggccttctccgccgcctccatctccgcgaacacgtcgatcggagcgggggccttggccaggaacacccaggtgagccagaccgccagcaggaacggcgggatcttcagcgcgaccaggacccagccgagttgggcggtgttggcccaccagtacagcgggaagaggatcgcgcacttggcgagcaggatcaggccccaggcccaacttgccttcgcgtacgccttcttgcggcccgggttgcgggtacgccaggagaggttctccttgaagaccgggccgaggatcaggccgatcaggggcacgcccgcgagcgtggtgatgatgtacgccagcgccagaccgagcgtgtagagcatgcccggcaggtagaagtccttggcgttgccggtcatcatcgcgaagaccacgccgaaggcgacaccgaagacaccgctgaaggcgtgcttgacggtgtccctcatgacgaggcggaccacgaccagcagcagggacaccgtgatggcggcgatcgccgaccagtgcaggtccttgttgatcgtgaagatggtgacgaagaggaggccgggcaccaccgtctcgaccatgccccggacaccgccgaacgcctcgaagagcgcggcctcggtcaccgccctggaatcctgctgggcgtcttccgtaggcttgtcgagcgacgtcaccggctactcccgtccgagcggtctgagttcgtacttcgggttgaacagcactctgcggccccggctcatcgagatccggcccgaagcgatcagcttgcgccccggctctatgccgacgatggaacgcctgccgagccacaccacgtccagtgcggccgagccgtcgaacagctccgcctccagggccgggactccggcccgcggccgcagcgtgaccgtgcgcaaggtaccagtaacggtgacgatctgccggtcatgacagtcgccgatgcgcgtacatcctgcggtctcggcgtcctcgcgcagctcctcggactccaggtcctcctgggacgaggagagccggtcgagcatgcgccggaaccggcccaccggcttttcggaatgaggaacagcgctcataccgaaagcgtaccgggggacgccgacagcaacgcactcgcggcgccaacgctctgaacgggcactgaccggccctggacactccgccgcccccgcacactccgccgccaccgctcgcatctcacctctcgaaccgatatcccatccccggctccgtgatgaagtgcttcggatgcgacggatccgattccagcttgcggcgcagttgtgccatgtacacgcgcaggtagttcgtctccgtcccgtacgacgggccccacacctcctggagcagctgtttctggccgaccaggcggccggtgttgcggacgagcacctccagcaggtgccactccgtcggggtgagccgtacgtccctgccgtcgcggttgaccttcttcgcggccaggtcgaccgtgaagtcctcggtctccacgatcacgtcgtcctcaccgccgcccgtgggctcggcccggcggacggcggccctcaggcgggccagcagctcgtccatgccgaagggcttggtgacgtagtcgtcggcgcccgcgtccagcgcctcgaccttctcgtcggaggagtggcgggccgagagcaccaggatcggcacccgggtccagccgcgcagtcccctgatcacctcgacgccgtccatgtcgggcagcccgaggtcgagcaccacgacgtcggggtggcgggcggcggcgacgtgcagcgcggtcgcgccgtcgtgggccgagtcgacctcgtacttgcgcgccttcaggttgatcacgagggcgcgtacgatctgcggctcgtcgtcgaccacgagcaccctcgtcggggtctgggggcctcccccggtcgggctcagcatctggtctgcctttctgctgttgcgtgcgcgaggccgggacggccggcggggctgtccaccgccgccccgaccgtcagcaccatggtgaggccgccgccgggagtgtcctcggcgttcagcgtgccacccatcgcctcggcgaagccgcgtgccaccgcgagacccaggccgacaccgacaccgcgcggggcgtcgccgtagcgctggaagggcgcgaagatgcggtccttcgcctcgtcggggacaccgggcccgcggtccaccacacggagttccacccggttggcgagggcgctcgcggccaccaggaccgactcgtccgaagggctgtacttgaccgcgttctcgacgaggttggccaccgagcgctccagcagaccggggtcgacggccaccatcggcagactctccgggatgtccagcaccacgctgtcctcgggcactccgccgagcgccatcggcaccacctcgtcgaggtcgatctcgcggatcagcggggtcacggtcccggtctgcagccgggacatgtccagcaggttgcccaccaggtggtcgaggcggtccgcgccgtcctcgatgccttcgaggagctccgcccggtcctcctcggaccaggccacgtcgtcggagcgcagggaggacacggccgccttgatccccgccagcggggtccgcaggtcatggctgaccgcggccagcagcgcggtacggatgctgttgccctcggcgagcgtgcgggcctggtccgcctcgcgctgaaggcgctggcggtccaggacgacggcggcctgggcggcgaacgcggcgagcacccggcggtcggaggcgggcagcacgcgcccggacagcgcgagggccatgtggtcgcccacgggcatgtccacgtccgcgtcctccggccggtcgaccagcggacgcacgcccacactgcccgcgcaggtccacggcgcgacgtcgctctcccgctccagcagggcgaccgactccatgccgaaggtctcgcggacgcgttcgagcagggcgtccagactggtctcgccgcgcagcacgctgcccgcgaggaaggagaggatctccgactcggcacgcagccgggccgcctgatgcgtacggcgggcggcgaggtccaccacggaggccacggagacggcgacaccgacgaagatcgcgatggcgatgatgttcttggggtcggcgatcgtcagccggtgcagcggcggcgtgtagtagtagttcagcagcagcgacccgaaggccgccgaggcgagggcgggcagcagcccgccgagcagggcggccgccacggtcagcgccaggaacagcagcatgtcgttggcgaggccgaggtcgacggtgttcagcagcagcgcgaggacgaccggcccggccacgccgaccagccagccccagatgatccgcgaccggccgagccgcgcaccccgggcgaccgggagaccgcgccccttggcgacctcctcatgggtgacgatgtggacgtccaggtcgggtcccgactcgcgggcgaccgtggcgccgacgcccggcccgaacatgtactgccaggccttgcggcgcgaggagccgagcacgatctgcgtggcgttgacgccgcgcgagaagtccagcagcgcggagggtatgtcgtccccgacgacgtggtggaaggtgccgcccaggtcctcgacgagcgtgcgctggacggccagctccttgggcgaggcggaggtcagcccgtcgctgcgggcgatgtagacggccatgacctcgccgcccgcgcccttctccgcgaggcgtgcggcgcgccggatcagcgtacggccctcggggccgcccgtcagtccgaccacgatgcgctcgcgcgagccccatatcgccgagacccggtgctcgctgcggtactccgtcaggtacgcgtcgacccggtcggccacccacagcagcgccagctcgcgcagcgcggtcaggttgcccgggcggaagtagttggacagggccgcgtcgaccttgtccggcttgtagatgttgccgtgcgccatgcggcggcgcagggcctgcggcgacatgtcgaccagctcgatctggtcggcccggcgcaccatctcgtccggaacggtctcgcgctggcgtacgccggttatcgactccacgacgtcgcccagcgactccaggtgctggatgttgacggtcgacacgacgtcgatgcccgccgcgagcagctcctcgacgtcctgccagcgtttggcgttgcgggagcccggaacattggtgtgagcgagttcgtccaccagagcgacggcgggggcccgccgcaggacggcgtccacgtccatctcggcgaagacggtgtcccggtacgcgagctccctgcgcgcgacctgctccagaccgtgcagcatcacctcggtgcgcggccgcccgtggtgttccacgaaggcgaccacgcagtccgtgccgcgctcgacgcggcggtgcgcctcggagagcatggcgtacgtcttgccgacgcccggtgccgcaccgaggtagatccgaagcttgccgcgtgccatggccccattgtcttcctgtcacagctgtgtacgctgcgtcgaccttacggccgatcatcacggcaaaaggcagggtgagcgcggtctggagcgtccttgacggaaccctgatacgcggcggggtcagctcgggttgtcgccgtgtgtgagcgtctcccaggcaacgaagaggttgttgctgccggccgggcggttctgctcggtcaggttctgggtgttggtcatggcgatgcccaggcggttgtgcagggcgttgtagccgacctcggtgatcggcccgagcccccggttcagggagcccccgcacagccagctcggtgccgcctcgcccagctggtacttggcctggaagccgagcgcctgccgcagccgctcgccgacgtccgtgccgtacaggtccgcgccctggatacggctggtctcggcgatgtgcgagacggcggagatgccgtacccggtgtgcgtgaagtcgcggcaggtctcctgggtgagcccggtgacgaaggtggactgcccctgccagtagctgacgatcttcgcggtcgtgtcgagattctggctcggcacggtcttcggcacagctccgtcggacgagagatagatgtacgcggccgtacgcgtacggaacttcgccatggccttgtcgtacgacgtcttgtcctccaggaagacggagatgccgacggcggcctccatcatcgacagctcccagttgccgttggagttggagccgttgatgatctcggggaggtacacgtcgcgcagcatggtcgcgaagcggccggagttcgcccaggtgccggtgtacgtgtacttgatgatctcggccgccttgggccacgaggagccggcccagccggtctgcaacggcgcgttgctgttggtgtggtccttgatcaccgccgaccacgcgtccatcaactcgatggccttcttcgcgtaccgctcgtcgcgggtgatgtaccaggcgagggcgtcggtgtacgcggctatcgcgtcctcacgctcgtccgtgcacccgtagttggggttggagtacgagccgcactcgacggtcgcgcggggcttcgcggtgcgcgtcagcgaagcgtacgtgctcgccatcatctggtcgtacgcgcccttccagggctgcgcaccggcgttgaccttggtgcgggagaagtccagctgactcctggagacggtgactccggggtgcgcgaaggtggccggtgccgcgtcggcgcgatgggcggcgggccaggcgaggaggccgcccaccagagcggtggccagggcggcgatgacggcggtgcgtggtctgcgacggtgcacgcgagagggcagcttgggcatgtgggggccatccgttctcgtatgtgaacgatgagcgcgtctttgaacaggtgcactggccggagaccataggtacagaccaactggccgtcaagaggccgcacatgagaacaccggggtacgagaaagggccgcacccccttgaggggtacggcccgaaacggctctccgaactagcggacctcggtgatctccggtccacgctgcaactgccccatgccgccggagaagcgcgaaccgctctgctcctcctgctggacaccctcggggaccatctgcgcgtcgttcggcagcttcaggacgatcgggtcgcggggcgccatcggaccctcaccgcggaccacgaccgtgtcccggaagatctgctccaggagaccggcggcctgcggctgcacggcaccctgaccggaaatgaccccgcgcaggaaccagcgggggccgtccacacccacgaaccggacgacctggaagccgcccgtaccgtccggcagctgtaccggcacctgcgcgcgcagctcccagcccagcgggccctcgacctcgtcgatgacaccgccctgctgggtgatgccgctggcgatctcctcgcggacctcgccccagatgccctcgcgcttgggggcggcgaaagcctggagctggaccgcgctgtcccgcagcacgacggtcgccgcgacgatcgcgtcgcccgcgacctcgacccgcagctccatgccctcgaccccgggcacgaacagaccgcccaggtccacccggccctcggccgggtcacggacctcggagctgtcccagggcccgtcgggccgcggctcgggctcgagccgcggccgctcgcgctcgccctcgtcgtccgcctcagcgtcgacgccgtcgacgacctgctcggcctcgcccgccgcgtcctcggcggcactgcccttcttgcgacgtccgaacacgtcactgtcctttccggtcggatacgaccgaagcgtatcgattcccaccctgttgcccgttcgtatcggcgcccacggcggcatgaccgccggtggacccgaagcccccctcggcccgcgccgaatcgggaagctccgccacctcctggaagcggaccctctcgacctgctggacgaccagttgggcaatccggtcgaagcgctcgaaccgcacggactcgcgcgggtcgagattcaccacgatcaccttgatctccccacggtacccggcatcaaccgtccccggggcattcacgagggcgacaccgcagcgggcggcgaggccggatcgcgggtgcacgaaggccgcgtacccctcgggcagcgcgacagacaccccggtgggcagcacggcccgttcgccgggcttcagttcgcagctctcggtggtccgcagatccgctcccgcgtcgcccgggtgctcgtacgccggaagcggtacgtcggggtcgactcgtcggagcagcacgttcaggggggcacgggtcatgggttcacctcgaaggcacgggcacgccggagctggtccgggtcgttcatggccgcccggatctcctcctggcggccgttgtcggtgaagtggtcgaccttgacctcgacgaaaagggcgtcggcgcggacggccacgggcccctcggggccgccgatccgtccggtggcggtcgagtagatcttgcgcccggccaccgccgtcacctccgcctccaggtacagcacggtgccgacgggcacgggccgtacgaagtcggtctcgagccggccggtcacggcgatggtgcgcagcagccagttcagcgagccgagggtctcgtcgagagcggtcgcgagcaccccgccgtgggccagaccgggcgcaccctgatgggcgggctgcacggtgaactcggcggtgatcgaaacgccctgacccgcccgtgccgccaggtgcagcccgtgggactgctcctccccgcacccgaagcagtgtccgtagtgcgcgccgaggagttcgccgggggcgggcgcatcggggtgccgcaccggcgtcgtggcgtcggcggggggcttcagagctgcggaagtaccactcacaggcgcagaccttacccgcgcgtcggcaccgggcggacaccgtgccaagcttggatccatgcagctttccgcgccgccgtacgaagaacgcctcaccgccccccgcacctggtggctcatgtgcttcctggtcggcgtctcgatggccctgatcctgctccccttcggcacactcccgctgctgggcggcctggtgggcggcacggcggtcgcggcggtcgtggccagctcgtacgggtcgatccgcatccgcgtggtcggcgactccctcatcgcgggcgaggcgaagatccccgtggcggccctgggtgaggcggagatcatggaccaggaggaggcgcgcgcctggcgcacgtacaaggcgaacccgcgcgccttcatgctgctgcgctcctacatccccacggccctgcgggtagaggtcacggatccccaggacccgaccccgtacctgtatctgtcgacgcgcgaaccggaacgcctggcggcggcgctgaaggcagcccgcacggaggcgtagcccgcggtcccaccggagacaccgccggcctctgcgcggcggcgcacatcgtcgcgcgcccgttcacgggcgtccgcaatccggcggcggtgcctgccggaccgggccggtcgcgggtgccgcccgtcagggccccagctccttggggatctcccccagccgcagcggatcggccggcttctccagcggtggcagctccggcagcgcgtcccatggcacctgcatcttccgcaggtccttgcggatacgccccgcaagccgcttggtgtcccggcggttcatgaccgccccgaccgcggcgcccaccatgaacggcatcaggttcggcagatcccgcaccgtccgcttcatgacctgctggcgcagttcgcgcctcatctggcccccgagggccacattgatcgtcgacggcttcgtcacgtcgatcccgcgctcccccgaccaggagtgcagatacgcggtgctgcgctgcgtcagcgtgcccggcggccgcagcccgtacacctcgtgcagctcggcgatcagcttcagctcgatcgcggcgacgccggtgatctcggcggccagctcggtcggcatcgccggcggcaccggcagcatggcggcggctccgatccccgcgcccaccgtggacgtggcgttggccgcgcccgtcacaagtttgtccgcgagctcctcgggtcccaggcccgggaactgcctgcgcagggtcgcgaggtcgcgtacggggatacgcggggcgttctcgatgatccggtccacgacgtacgccaggcccgccctggcccggctgccgcccttgcggacaccttcccggaccccgtcacgtacgacggccgcccggcgtctggcgacgggcggaggaggatccggatccacgggcgccggaagccccgaaggggccgcggcgtccacagtggcggccgacggttcgagcgaggctgatccaggctcggaagagccccgctcgtcgtcacgcgcgccgtgagagccgtcgtgcggctcttcgtccgctccccggcgggggaagcggcgcttccagggaggggtcgagccagtcacggccgacccgccctcagtcgcagtcgcggcagatcggctgaccgttcttctcgcgggccagctggctgcggtggtgcaccaggaagcagctcatgcaggtgaactcgtcctgctgcttgggcagcacccggacggccaactcctcgttcgagaggtccgctccgggaagctccaggccttcggcggcctcgaactcgtctacgtcgaccgccgaagtcgacttgtcgttccgcctggccttgagctcctcaagactgtcggaatcgacgtcgtcgtcggtcttgcgtggggtgtcgtaatccgttgccattgtcgctctccccctctgggtgtctgcgtgtgtcttcagcgcacgtaacgcgtgagaggccggacttgtgcccgcctcgaggcggagattttgcctcacatcaaggtctgttactcaatcgacacccaagcggacccctcaagagtgatcggcttggatggcgatggggaccgtacacggtcttcatgccgctctacaaaggcgtctcaccgtgtacttcccgtgatctggacccccgaaaacccggattttcccggctttccggccgtccgcatgatcacggagagtagatggccggaaagtcgctcttgtgatcgatcacacacgagccgcctgaatcgacggcccgaaaattccgcgcaaagcgaacatcggccgcgtgtcggcgccatgctctcagatcggcagggtgacgcgcatcacgagcccgcctccttcacggggctgggcggcgatgtggcccccgtgggcgcgggccacggaccgggcgatggacagaccgagccccacccccttgtcgctgcccgtgcgctccgtacgcagccgcctgaagggctcgaagaggttgtcgatctcgtacgcgggaaccacgggacccgtgttcgagaccaccagcaccgcgtgcccgtgctggacctcggtggtcacctcgacccagccgtcctcgggcacgttgtaccgcacggcgttctgcaccaggttcagggcgatccgctccagcaggacgccattgccctggacgaccgcggaggcccgctcgccgcggaactccacgcccttggcgtccgcctcggaccgcgcctggtcgatggcctgcgaggcgacctcggcgaggtcgaccggcttgcgctccacgatctggttgtcactgcgggcgagcagcagcagcccctcgacgagctgctcgctgcgctcgttggtggcgagcagggtcttgccgagctgctggagctccatcggggcgcccgggtcggacaggtgcacttcgaggagcgtgcggttgatcgcgagcggggtacgcagctcgtgcgaggcgttgccgacgaaccgctgctgggccgtgaaggcccgctggagccgctccagcatgtcgtcgaaggtgtccgccagctccttcagctcgtcgtcgggaccgtccagctcgatccgccgggacaggtccgagccggccaccgcgcgggcggtgcgggtgatccgcccgagcggcgacaggacgcggcccgccatcgcgtatccgaaggcgaaggcgatcacggcgaggccgagcagcgcgagcagtgagcggctcagcaggttgtccagggcgacctggcgctggtggtcggtgcacgcgctgatcgcgtcgttgaacgccgtcagcggaatgttgttcgtgctgacgcccgggcagtcgtcgctggcgaccttgatgccgttgccgtcgaggatcttgaacagcggttcgctgcccgtccgcagcgcctgcgcggccagcagatagatgatcgacagcagcaggatgccggcgatcaggaacatgccgccgtacagcagggtgagccgtatgcggatggtgggccgcagccaggggaacggcgcctcctgccgcctggggtcccaggtcggcttcgggggtgcggcgggcggtgcgggtgtcgtcgccacggccgctcagatccggtagccggagccgggcacggtgacgatgacaggcggctcgccgagcttgcggcgcagcgtcatgaccgtcacccgtacgacgttggtgaaggggtccgtgttctcgtcccaggccttctccaggagctgctcggcggagaccacggcgccctcgctgcgcagcagcacctccagaacggcgaactccttcggcgcgagctgcacctccttgccgtcgcggaagacctcgcggcggttggggtcgagcttgatgccggcgcgctccaggacgggcggcagcggcacactcgtccgccggccgagagcacgcacgcgtgccgtcagctcgctgaacgcgaacggcttgggcagatagtcgtcggcgccgatctccagaccctcgacgcggtcgctgacgtcgccggacgcggtgagcatcagcacgcgcgtgggcatgccgagctcgacgatcttgcggcagacgtcgtcgccgtgcacgagcgggaggtcgcggtcgaggacgaccacgtcgtagtcgttgacgccgatgcgctccagggcggccgcaccgtcgtacacgacgtcgacggccatggcctcccggcgcagtccggtggccaccgcatcggcgagcagctgctcgtcctcgacgacgagtacgcgcacgtcgctgtccttcctctgtccacccgcgtagcgcctcctgggcgcacgcgggcggggtctgatgggggtccccccgctcgagcgcagccgagaggggggagggtgaggcctccatcctgcccgtttcggccataaaccggctgtaaggcgggttggcggagcagggacgacggtccgcggggccgggaatgcgagattttctcttcgggtttgaggtttccgcggaagagagtggggggaggacggctttacatcccgcgatcacgctctgcatgtggcacgccaccatgtggtgggccactggccgctttccgcggagcgggcgtgggtgtccggcaccgtcgccgcccagcacgggctgcgctgggcacctactggagacgtgatcgccccttccgaacggcacacccccgtgccaccgacccacgacccaggacgagggggcgcagcatggacgcattcaccacaggaattctgcagcgcataagggctaccgagtccgacctgacgcgggctcgcgagacaggcgacgacttcctcgcggaggtcgagcaggcagagctcgacgacctgcgccgcctcgccgccgagcacggtgtggaggtcggcgcgacacgcgtctgatcagcttgtgcaggagcggggccccggcagatccaggccggggccccgcttcgtgccgcggacggcggcactcagtcgtgccaggccccgaggtcctccaggcgggtctggagcgcctcgaagaggccgggcggggcggcgatcgtcaggtcggtcgagaggggctctccggggcgtccaccggtcagcgcgcccgcttcccgcgcgatgaggtcgcccgccgcgtagtcccaggggttcagtccgcgctcgtagtacgcgtccaggcggccggccgccacgtcgcacaggtcgatcgcggccgagccgccgcggcggatgtcccggacctcggggacgagctgccggacgacctcggcctgccgggcccggcgctcggcgagatagccgaagcccgtaccgacgagggccagtccgaaggcgggcgcgggccgcacgcgcgcggggaggtcgttgacgaaagcgccctgccccaggacggcgctgtaggtctcgccgcgcatcggcgcgtgcaccacgccgacgagcgtctcgccgtccttgcgcgcggcgatggagacggcccagctgggcaggccgtacagatagttgacggttccgtcgatggggtcgatgacccactggacaccgctcgtcccctcgacgtcggcgccctcctcgccgagcacgccgtcgtcgggcctgcggtcggccagcaggccggtgatcagcttctcggaggcgatgtccatctcggtgacgacgtcgacggcgctggacttggtcgcggccaccccgaggtcgtcggggcggccgtcgcgcaggaaggctcccgcgcgggccgcggcgtcgagcgcgatctccaggagttcggccttgaggtggtccaggtgctcggactggtcggtcacggtgctcctcacgcgtacgggctgtcggcgcccgcggcggcgggcttgggggcgcgggcggggcagcagcccaccggacacagctggtggctcgggcccagcgcgcctagggcgcacggggtcaccttctgtccgctctcgacggcggcacgctccacgaccagctcgcggaccgcggcggcgaaccgcgcgtcggcgcccacggtggccgaacggcgcaccggcagccccagctcctcggccttcgccttcgcctccgtgtcgaggtcgtacaggacctccatgtggtcggagacgaatccgatcggcgccatcaccacggccggcaccccggcgccgtgcagctcctggaggtggtcgcagatgtccggctccagccaggggatgtgcggggccccggagcgggactggtagaccagctgccagggatggtcgatcccggtctcctcccgcacggcgtccgcgatcagccgcgcgacgtccaggtgctgcttcacatacgccccgccgtccccgtgctcctcgacgggtccggaggtgtccgcggcggcggtggggatggagtgcgtggtgaaggcgatgtgcgcgcccgggcgcacgtcctcgggcagctcggcgagggacctcagcacgccctcggtcatcggttccacgaagccggggtggttgaagtagtgccgcagcttgtcgaccctcggcacctccagaccctcggcctccagggtggccagggcgcccgcgaggttctcgcggtactgccggcagcccgagtacgaggcgtacgcgctggtggccaggaccaggatgcgacggcggccgtcggctgccatctcgcgcagggtgtcggtcaggtagggcgcccagttgcggttgccccagtacacgggcaggttcagaccgtgctcggcgaaatccttgcggagggcgtcgaggagagcgcggttctggtcgttgatggggctgattccgccgaacaggaagtagtgctgccccacctccttgagccgttccctggggatgccgcgtccccgcgtcacgttctccaggaacgggaccacgtcgtccgggccctccggacctccgaacgagaggagcagcagggcgtcgtaagggctggcatcgagtgcttcgggcatgtctacgatcctgccacccgccgccgacaacgatctcgtcacccgcccgacgggccgtggcctccgccgggacgtgcgggttcctgggtgcattagggttacctaactcgtaagctgtatcgaccagcttcgcgccttaccggactcaccggagacccctcgtgccaagcccctaccgcgccctgttcgccgccccaggctccaagggcttctccgccgcgggcttcctcggccggatgccgctgtccatgatgggcatcggcgtggtgacgatgatctcccagctcacggggcggtacgggctcgccggcgcgctgtcggccaccatcgcgctgtccgccgcggcgctcggtccgcagatctcccggctggtggaccggcacgggcagcggcgtgtgctgcgcccggcgacgctcttcgcgctgaccgcggccgccgcgctgctgctggccgcgcactacgactggccggactgggtgctgttcgtctgctccgccggcatcggctgcgtaccgagcctcggcgcgatgacccgggcccgctgggcgaacctgtaccgggacaccccgcagctgcacacggcgtacgcgttcgagtccgtcgtggacgaggtgtgcttcatcttcggcccgatcatctcgatcggcgtctccacggtctggttccccgaggcgggtcccctgctcgcggccgtcttcctggccctcggtgtcttctggctgaccgctcagcgggccaccgaacccgagccgcatccgcacgagcagcacagcggcggctcggcactgcgcgcggccggactacaggtcctggtggccacgttcgtggcgaccggagcgatcttcggggccgtcgacgtggtcaccgtggccttcgccgaggagcagggccacaaggcggccgcgagcgtcgtactggcgctgtacgcggcgggttcctgcgtcgcgggagtcgtcttcgggctgctgcgcttcacgggggcggccgaacgccggtggctgctgggcatatgcgcgatggccgtgagtatgatccccctcctactggtcggaaacttgccgttcctggccgtggcgctgttcgttgcgggcctgtccatcgcacccacgatgatcacgacgatgtccctcatcgaacagcacgtaccacgcgcgaaactgaccgagggaatgacctgggtgagcaccgggctcgcggtcggcatcgcgctcggctcctccgtttccggctgggtgatcgacgccgccggtgcgcgtgccgggtacggggttccggcggtgtccggggccgtcgcggtcgcggtcggtttcctcgggtatcgccggctgagcaggccggctccgcagcggggagggtcccatgagcaccacagtgagcgggaagagcggcacgtggcgtaactgggcggggaacgtcaccgcccggccggtacgggaggtcactcccgcttccgtcgaggaactctccgccgccgtacggaaggcggccgacgagggcctgcgggtgaaggccgtcggaaccggacactccttcacggccgccgccgcgaccgacggtgtattgatccgccctcaactgctgacggggatccgcggcatcgaccgcgaggccggcacggtcaccgtggaggccggcaccccgctcaagagactcaacgtggctctcgcgcgcgagggtctctcgctcacgaacatgggcgacatcatggagcagacggtctccggcgcgaccagcaccggaactcatggcacgggccgtgactcggcctcgatcgccgcccagatcaagggccttgagctggtcactgccgacggctcggtgctgacctgctccgagaaggagaatccggaggtcttcgcggcggcccgcatcgggatcggcgccctgggagtggtcaccgcgatcacgttctccgtagagcccgtttttctgctcacggcccgcgaggagccgatgagtttcgacaaggtcaccgccgacttcgacgaactcttcgccgagaacgagcacttcgagttctactggttcccgcacaccggcaactgcaacaccaagcgcaacaaccgcagcgcgggaccggagaggccggtcggacagctcagcggctggatcgaggacgagttcctctccaacggcgtcttccaggtggccaatctgctcggccgagccgtgcccgcgaccatacccaccctcgccagggtctccagccgggccctgtccgcccgcacgtacaccgacatcccctacaaggtgttcacctctccgcgccgggtgcgcttcgtggagatggagtacgcggttccccgcgaggccctcgtggagacgctgcgcgaactgaagtcgatggtcgaccgctcccccttgcgggtgagtttccccgtcgaggtgcgcacggccccggccgacgacatcacgctctccaccgcgtccggccgggacagcgcgtacatcgccgtccacatgttccggggcacgccgtaccaggcgtacttcaccgccgcagagcggatcttcaccgcgcacgaggggcggccgcactggggcaaggtgcacacgcgcgacgcggagtacttcagcggggtctacccgcgcttcggcgagttcacggcgctgcgggaccggcttgacccggaacggcgcttcgggaacgactacttgcgtcgggtgctggggtcgtagccgagacgctgggcgtcggggtcgcactgggcaggctgccgtcggagccggcgtccgggctcttcgtggcactgggcgtcggcgtcgggtcctgtgtcgtaccgccctcgccgctctccgaggaggcgtcgtccgacggcgcagggcggacgctggacggcgtccgtgagggggacggcgaattgtccgtcgtcggcggcgtcttggtgcggccggccagcgcgcccccgaccgtggtgctgaccccgccgctgaagctgtcgccggagaccaactcgtaggtggtgatcccggccatcgtgacgccgaacacgagggtggcggcgaccaccggtcgcttccagctcttgacccgcgcccggtagaccgtgccgtccgtgaactcacccgaagccgcggccgccaccggccggaccggctcaccgggccggcggccggccgacacgcgcggcttgggctgcacggtgacctcgcgcagctgctcaccggtgcgactgaagaagtgctggaagaccgtgccgccgcaggtggcgacgacgctgatcaggccggcgcccaggatggtcccgtagacgccgaagcaggaggcgagtttggcggccaccaccgcggccacggcactgcccgcgacctgagggacgctcaggtccagcctcttcctcccgggctcctcctcgctatccggcctcgcaccgacttccggcttctcacgcatacccggagcttgcctgcctttcccgtacttgatcgacccactgcactagagggggacgtatgggcgaaaccattggttccgcttctgccggatacgtgaactacgccacgtttgaggggcacgaaaacggcacaccgggcagtcaactcccaccctccaccagaagttgagcggcgtgccgatccacgtaagtggcccgaatggagtactgttgcgagccctgggtccggtctcccgccagggtgtccggggccttccaggaccgccgggagggggctagttgcacagggtgatggagttcgtcacttagcgttgcgaacaggtaaccgtgccataacggcgatccagggcccgtgcccgacacgccgggcaactcggcaaggttgtggcaggctgcacccgggcaggccacactcgactagcggaagcagcgacgcacgtgacgtcggcaggcaccacccgggaggtccccatgcccgaactgcgtgtcgtggccgtctccaatgacggcacacggctggtgctgaaggctgcggacagcacggagtacacgcttccgattgacgaacggctccgcgccgccgtgcgcggcgaccgtccccgcctcggccagatcgagatcgaggtggagagccatctccgcccccgagacatccaggcgcggatacgtgccggcgcgtccgccgaagaggtggcccagctcgccggcatcccggtcgatcgcgtacgccgcttcgaggggcccgtgctggccgagcgcgccttcatggccgagcgggcccgcaagacccccgtccgccggcccggcgagaacgccggtccccagctcggtgaggccgtccaggagcgactgctgctgcgcggcgccgacaaggacaccgtccagtgggactcctggcgccgcgacgacggcacctgggaagtgctgctggtctacctggtcgcgggtgagccgcactcggcgagctggacgtacgacccgccgcggcggctcgtccaggccgtcgacgacgaggcgcgctcgctgatcggcgagtccgacgacctcgcggcgcccgagcccagcttcccgttcgtgccgcggatcgcacgcctgccgcgcgaccgcccgctggaccgcgccctggaccgccagacggaacgtcccgccctgccgtcgcaggcacccgagcccgcggaggagagcacggctgagcgcgactcgctcaccagcctcctggaggcggttcccagcttccgcggggacatggtggtgcccgagcggcccgcggaaattcccgcaggacaggacgagcccgcccccgagccggaggcggaggagcccccggcggcatcggcttcggccggttccgcgtacgcggacgtgctcatgccccgctcggtcggcagccaccgcgaccgactggtcggcgcgaccgaccgccaggccgaggcggacggcgtccgtccgggccgcagagcggccgtgccgagctgggacgagatcgtgttcgggacacgacgcaagaagcaggaatagccggccgagccggagcgaccggtcgagtcatcgacagtacgaggacggggtccgcgccgagtcggcgcggaccccgtcctcatcactgggggtcgggacccgcggcgacgggacggctgccggccgccgaccactccgaccaggaccccacgtagagcgcggccgggattccggcgaccgccagcgcgagcacctcgtgcgcggcggagacccccgagccgcagtacacgccgacctcggccgcgtcgttcacgccgagcgacttgaagcggtcggccagttcggcagcgggccggaaccggccgttctcggccacgttctccgtggtcggggccgacaccgcgcccgggatgtggccgccgaccgggtcgatcggctccacgtcaccgcggtagcgctcggcggcccgcgcgtcgagcagcagaccggtacgggcgagcgccgcggcgccgtcggcgtcgagaagcggcagggcgccgggcgcgggctcgaagtccccggcgaccaactcctcggtctccgtggtcaccggtccgctccacgccgcgaggccgccgtcaagcactcgcaccgccgggtgacccgtccagcgcaacatccaccacgcgcgcgcggcggcccagccctgcccaccgtcgtacacgaccaccggccgccgcgccgagacaccggcggcccgcatggcctcgccgaagtgcgcgagatccggcagcggatgccgtccggcagggcccgcggggccggccagatcggcgtccagatccacgaagacggcgccgggaacgtgcccggacgcatacgcggcccggccgtcgaacggggcggcaccacccgccttggctgtgctcagctgccagcggacgtccaggagggtcggcgggttcggccccgccagctcgctcgccagttcggatgcggagatgatgacgttcatggcccccatccttgcgcacggggtggccacccggcccaggtccggctactctgctccgccggacaggtctgatcacaaggcgtatgggatcgggcacgtgccgtacaggcgagcgacatcgcgcgatcatcacccggaaacacacaggacaccgcacatcgggcatcctccgcgaaagaactcatgtccggcggtgccgccggagggcgcgatgcgaccggtggtgcgagcatcggcaccgggcgtgcacgcgcgatatcgcggtacccgtgtacccaggcggaagtgaacggccaccgcgaggggccgagaagagagtgacgatgaccgaggcacgggggccggccggccgcaacggcaccacagacgccgggtacacgccgggcacaccctgctgggtgagtctgatggtgcacgggatggccgcgacccaggagttctacggcgcgctgttcggctgggagttccagccgggcccgcagcagctggggccgtatgtgcgggcgctgctggacggccacgaggtggccgggatcggccagctgccgcccgaccggcacctgcccgtcgcctggacgccgtacctcgcctcggaggacgtggacgcgacggccgagaccgtgcggcaccgcggcggcacggtgggcgtcggccccctggacgccgccgaggccggccggatggccatcgcgtcggacccgatgggcgcggtgttcggcatctggcaggagtccgcacacctgggcccgaggctgaccggggtgcccggcacccccacctggaacgagctgctgacctacgactccacgagtgtcgccaagttctacgaggcggtcttcggatacgaggaggagccggtggtctccgccgacttcgactacatcaccctcaaggtcgagggccgcccggtcgcgggcatccacggcgtcggcaacgccgtcccccgcgaccgggggccgcactggatcacgtacttccaggtcgcggacgtggacgagacggccgctcaggtgacggacctgggcggtcacgtcctgcgtcccccggcggaatcggcccacggccgcgccgcgacggtggtggacccggagggggcgatgttctcggtggtcaccacgagcggctgaggaggcgcgggagacgcggctttcatccgccgaaaactcgtccgagccctcgggacggtcggcaggtggccgtcaggcggaagtgaccggcagaacgtccggcgagatcgcggcggcgtatgcggaggcgctggtcatccggcggcggtggtggcgccggcacagcacctcgtagccgacctccgccgccgggcggttcacgtcaccgacgacgacctgctcgccttccacgaccatctcgccgcccaccgtgcgggcattgtgcgtggcccgcgccccgcaccagcacatcgcctcgacctgaagggtctcgatccggtccgccagctcgatcagccgctgcgagccggggaagagcttcgtacggaagtcggtggtgataccgaaggcgaagacgtccaggtccaggtcgtccacgacgcgcgccagctggtctatctgctccggcgcgaggaactgcgcctcgtccacgatcaggtagtcgaccttgccgcccttcgacatctgatccaccagatacgcgtgcagatccatgcccggagccgcctcgaccgcctccgtcaccaggccgagccgcgacgacagctttccctccccggcacggtcgtcgcgcgtgaaaatgacgccctgcaggcccctcgccgaccggttgtgtccgatctggagcgccaacgtcgacttcccgcagtccatcgttccggagaagaacacgagctcgggcatggcgggttgagaacctttcagggcagggagaagagagggcttcgcaagggggtggcgagcgtcaggtgcgtacttccagcagaggcaccagctgttccaccggcgtcatcgaaccgtggttgccgaccatcgccgactccttcggctcccgctcggaggcgatgatcagcacgtcgtcgcgggccgccgcgaccacgtcgccgatgcgcgcgtacacccgctcgtcgacgtcgggcccgaaccagcccgcggcgatcgcctcgtcccgcgaagcgatccagaactgctcgccgagcacctcgcgccagcaggtcagcacgtccacctgggcgcccggcaccgcgtacacatgacgagcccggccctcgccgcccagcagggcgaccccggcacgcagctcccagtcctcgtcgaagtcgatgcggtgctgctcgtcgaacgggatgtcgatcatgccgtggtcggccgtgacgtagagcgcggagcgcggcggcagctgctccgccagtcgctggaccagtcggtcgacgtacatgagctggccacgccacgggtccgagtcgacgccgaagcggtggcccttgccgtccacctcggcgtagtacgtgtagaccaacgagcggtccccggcggccagttgttcggcggccaggtccatgcggtcctcgccggacaaccgcccgtggaacgttccaccgctcagcgcgaccttggtcagcggggtgttctggaaggtgggggacgagacctgggccgtgtgcacccccgccgcgtccgcgagctggaagaccgtggggtacggctgccaggcgcgcggatcggtccacggctgccagcggagctggttcatcagctcgccggtctccgggttgcgcgcgctgtagccgggcaggccgtgcgcgccgggcggcaggccggtgccgacggaggcgagggaggtcgcggtcgtcgccggatagccggcggtgatcgggcggcccgtgccgccgcgcgaggactccaggagggacgccatgaagggcgcctcctccgggtgcgccctcagctgctcccagccgagcccgtcgatcaggaagacgcagttccggtcggcggcggtcagctcctgtatggcggcccgctggccgggcacctccatgcccgccgcgagcgtgggcagcaggtcggccagcgaaccggcaccgtactcgggaaggggggcggagtcgacggccagcggttccgggtcgtcccaggtgggcagagccatcagcgcgcgacgtccgcggtggcctcggagagggactgtgcgaagaccagggcctggcgcaccgtctcggggccgtccccggcctcgctgacgcgcaggctcagatcgtccgccgtcgagttgcccgtgtatccgtggtccgcctcgcagttggggtcgccgcaggcggcgggctccaggtcgatacgggagaccgcgccccagccgatggtcaggacgacctcgcggggcagggtgcccggcttgtacgactcggggttggcgaccacccggctgacgacgaccgacgagatccggccgagcttcacggactccgtcgatgtcgtggcgtacggcgtcggcgaggtggtgtcggcggcctgctcgtcggtgtggctcacgatgaagcggttgccggtgaggacgagcacggtcacatgccgtcgcacctcgttggcgtcgaacgtcgtctcctggtggaccaggtacgaccggatggcctcgccgccgatcgcggcctccaccgcctcggccacgagggccgggtagtagccgctgcgctcgatcgccgcacgcagcccctgggtcgtcgtactggtcttggccatgacgtccatcctacggtggcccactgactgcgaggcaccgctcggcgtccactcagtacaccggaagcgttctcgggcccaggtcgtcgcggacgggcggcggtgcgagccgtacggtcgccccgagcacgctcaggccgtgctgggccacgaccacgggctccagggtcacggcgacgacctcgggatggtcgtccaccagccgcgacacccgcagcatcagttcctccagcgcaggcgtgtcgaccggcgccgagccccgccagccgaagaggagcggcgccgtccggatcgacctcaccagcgaggtggcctcgcggtcggtgaccggaatcagccggtgcgctatatccccgagcagctgcgaggcggccccggccagcccgaacgacagtacggccccggccgccgggtcgatcaccgcgcgtacgaccgtgtcgacaccgcgcggcgccatcccctgcacgaccggccgcagctcctccggctttccgaacatttcggtcaattcggcgtacgcgcgccgcagttgctcctcgtccgcgagatcgagccgtacgccgcccagatcggcgcggtgccgcaggtgcggggcggtggccttgagggcgaccgggtagccgatggcgcgggcggcctcggcggcgtcgtcgggcgtcggcgcgggcagtgccctgcgtacgccgatgccgtaccgcgagagcagcgcgcaggtctcgtcggtcccgagggtcagcccctgtccgctcgcgagcagccggtcgatcagctcggcggcacccttctggtcgatgtcgtcgtactcgggcaccttgccggggtcggcggcgtcacgccgccactgggcgtatttgacggcttccgcgagggccctgacggcgcgttccgcggcggggaaggcggggatgaggcgggccccgtcgggggcttgcgccgcggcggacaggcgttccgcggggcgatgcgggtccccgcgctcggccgaagccggcagcgacggcgggtggcccgccacgtcggtcggctgcggtgcggtgctggccgccgcggacagcgcctcggcgagcccacccagctccacgtgcaccaccagcaccggcttcgccggagccgccgcagcggcggaacgcagtgcctccgcaagggcctggtcggccgccgacgtctcccccaccgcggggatggccgtcacgaccacggcgtcgcacccgtcgtccgccaaggcccgcgccagcgccgcgtggaagtcctccgccgaagccgccgtcgtcaggtccagcgggggaagcggtcgcaacccctcggccaaacaggcgtcgtacgtcagcagcccgagcgactcggagttcccgaggatggccacccggggccccgacggcagcggctgccgcgcgagcagcaggcccgcgtccaccagctcggtgatcgtgtccacccggatgaccccggcctgccgcagcagcgcggacacggtggcgtgcgggagccgtgtggcccgtacggcatgcccttgcggcgcggccccgccgtggcgcgcgccctgcaccacgaccagcggcttcgccgccgccgtacgccgggcgaggcgggtgaacttgcgggggttgccgatggactcgaggtacatcagggcgacatcggtgtcggggtcgtcgtaccagtactggagtacgtcgttgccggacacgtccgcgcggttgccggacgacacgaaggtcgacacgcccgtgtccccggtgacgccgcccccgcgccggtgcagccgggacagcagcgcgatcccgatggcgccggactgcgcgtacagaccgatccggccgggtcgcggcgtctcgggcgcgagcgaggcgttgaggcgcacctcgggggacgtgttgatgaccccgaaggcgttgggaccgatgaggcgcatcccgtaggtacggatctggcgcaccagctcgcgctggcgctcgcgcccctcggggccgctctccgcgtaaccggacgagacgaccacgagcccctgcaccccgtgctcgccgcactcggccacggcctcggggacgtgcgccgccggcacggcgacgacggccaggtcgacgggctcggcgatgtccaggacggagcggtgcgcgggcacctcgtcgaagttcttcaggtcctcggggaacgccctgttcacggcgtacagacgaccggtgaagccagcgtcgcggaggttgccgaggatgctgcggcccactccgccgggggtgcggcccgcgccgatcacggcgaccgcgccgggcgcgagcagccgctgcacggaccgcgcctcggcccgctgctcccgggcccgctgcacggcgagcgaacggtccgtgggctccaggtcgaactccaggcgtacgacgccgtcctcgaagctgcgcttctgggtgtacccggcgtccgtgaacaccttgatcatcttgctgttggcggggagcacctcggcggcgaaccggcggatgtcccgctccctggcgacggccgcgatgtgctcgaggagggcagaggcaacaccccgcccctggtgcgcgtcctgcacgaggaaggcgacctcggcctcgtcggcgggcgcggaggcggacaggccggcggcattaatacggtcatagcgtacggtggcgatgaactcgccgccgatcgtggccgcgagtcccaccctgtccacaaagtcgtggtgcgtgaagcggtggacgtccttggcggacaggcgcgggtacggggcgaagaaccggtagtacttcgactcgtccgagacctgctcatagaagctgacaagtcgctcggcgtcgtcgacggtgatgggcctgatgcgcgcggtaccgccgtcgcgcagcaccacgtcggcctcccagtgggcggggtactcgtgccggtccgacgcggtctgcatgggccccacagtacggctcgcgtccgacaacagcgcgaggcaggctaaggggaacccgacagggaccgccgggcacgcatcacgttatgggacactggtctagacaacctgagacacctgaagggcagcatcaacatggctgagcgccgcgtcaacatcggctgggccgagggcctccacgcccgccccgcgtccatcttcgtccgggcggccacggcctccggcgttcccgtgacgatcgccaaggcggacggcaaccccgtcaacgccggctccatgctggctgtcctcggcctgggtgcccagggtggcgaggaggtcgtgctcgcctccgacgccgagggtgcggacgcggccctcgaccggctggcgaagctggtctccgaagggctcgacgagcttcccgagaccgtctgaggtgagccctcgggccgtccgaggtgagccctcggaccgccggggtgtcccttcttcgcgtccgagccggtgtcgctcgcgcgggcgcggtggcgcgacgttcgggacgttcgggacgttcctcaattgatgatgcggtggccgtcgcttcgaagacaccattccgcacatactttgaaaggctcgcccgaaatatcgggcgggcctttcgtatttctgtctcacgggcagcagaaataatctcccgcgaattccatcctctttgtatacggcgcccttgttaatgccgcaggctcgtcatgtttacgggatgttgcgaagtcctcacacgttccgggcggtctccgccgccgggaaaacggagccggtgcaccgcactcgcgcgttcggtgtgcagggccgtgatcgcccgggcccgctcactgtcgccgcgcgcgacggcgtccacgatgccgccgtgctccgcccaggactccgccgggttggccggcgcctccaccgcgtacatccaggcgatcttgtgccgcagctgggccagcgtcgaggtcagggcggggctcccggaggcctgcgcgagcgtctcgtggaaccagccccccagggaccgcagatcctcgctgctccccctcctggaccgctcctgccccagcctgacgaggccgcgcagcaccttgaggtgggcctcggtgcgacgctgggcggcgcgcgcggcgcccagcggctccagcagcatgcgcatctccagcaggtcggaggcctcctgctcggtgggctccgcgacgcacgcgcccgcgtgccgacgggtgacgacgaacccctccgcctccagcgtgcgcagggcctcgcgcacggggacgcgcgagacgccgtagcgccgcgcgaggagttcctcggtgagccggctgccgcgctcgtagacacccgcgacgatgtcatcacggatcgccgtgcataccgagtgcgccggaatacgcatgaccgacctccgtcttaatccccgtgaaacgtcgccgattgacgtgtgttcaggcgactctattgcagcgggacggaatttccgatggcaggccggaatccatggatattttttggacagacagcagttcgaaacaacgaaggtcccggctcggtgagccgggacctcggaagggacgtgcctgtcgggcaggttgtcagacgttcacgccgtgcgagcgcaggtacgcgaccgggtcgatgtccgagccgtactccgcggtcgtacgggcctcgaagtggaggtggggccccgtggtgttgcccgtggcgcccgagatgcctatctgctggcccggggtgaccgtctgaccgacggagacgccgatggacgacaggtggccgtactgcgtgtaggtgccgtcgttcatcttgatgacgatgttgttcccgtacgcgccgccccagccggcctccacgacggtgccggagccgaccgcgtggacggaggtgccggacgcggcgtggaagtcgacgccggtgtggctgcccgaggaccagagggagccgccggacttgtagcccgtggagacgtacgagccggcgatcggggccacaaacgtgttcagacgcttgcgctcggcctcacgggcggcgcgcgccttggcggcgtgctccttctcggccagctcggcggccttcttgcgcgcggcctcctcggccttcttcttggcggcggcctctgcggcggcctgctcctgggcgacggcctgggcgtcgacctgggcggcgaccgagtcaccgatggagacggcctgagtcagcccggtctgctcgacggagggttcggcggagggctcggcggcgagcgccggagcggccagggtgccgatgacgccggtggtggtgagcgccgcgacgcccacggcgtgcgtggtcgtgcgcttcgtgcggcccggacgacggtgcttcccggtggcgcgggtgaacgccatgaagtggctggtcctttccttccttctcgcctaccgggttagctgacgggttcggagcaggaaggtctcctacgggctccctcaggagagggtgcccgattcaccccagggactgcgatgggtccccggctcccctggctcgcgccatacggggactcggcgatgactgtccggtgccgcgggcgcggcgcactgcctgacgaacagccggactgacgctaagcgtgggctctttcaatcaacaaacggatcgaggtttttgtagcgcacgccacaggtcagacgcatcacctctatggcaatacggacaaactctcagcaaacagggccctggtgactcttcagtcaccagggccccgcggtgttccgctgcttctactcggctgccacgacgctcacttcgccgataccgagggccttgaccggctccgcgatctgggcggcgtcacccacgaggacggtcaccagacggtccatcgggaaggcgttcacggcggccgcggtggcctccaccgtgcctgtggcggcgagctgttgatacagcgtcgcctggtagtcgtccggcaggtgctgctcgacctggtcggccagggtgcccgcgacggccccggcggtctcgaacttgagcggcgcgacgcccaccaggttctgcacggcgatgtcgcgctcggcgtccgtcagcccttcggccgcgagcgtgcgcagcaccttccagaggtcgtcgagcgcggggccggtgttcggcgtgtcgacggagccactgatcgcgagcatcgcgacgcccgtaccgtcgggggctgagcgcagcacctgaccgaacgcccgcacaccgtaggtgtagcccttctcctcgcgcaggacccggtccaaacgggaggtgagggtgccgcccaggcagtacgtgccgagcacctgggcgggccacacgcggtcgtgccggtcggcgccgacgcggccgatgagcagctgcgtctgaacggctccggggcggtccacgatgatcacgcggccgctgtcgtcggcggtcaccgggggcaccggccgcggctcggcggacgaacccgtccaggctccgagcgtctcggcgagcagcccgtcgaggtcgacgccggcgaggtcgccgacgaccaccaccgtggccgtggcggggcgtacgtacctctcgtagaaggcgcgcacggcggccgagtcgattttctggacggtctcctcggtgccctggcgggggcgcgacatgcgcgacgtggccgggaacaactccttggagagctccttggcggcgcggcgggccgggttggccgtctcgtgcgggatctcgtccagccggttgcgcaccaggcgctcgatctcgctgtcctcgaacgccggtgcccggagggcgtcggcgagcagtccgagcgccttcgggaggcgggagacggggacttcgagggacaggcgtacgccggggtggtcggcatgcgcgtcgagggtggcgccgcagcgctccagctcggcggcgaactcctcggcggtgtgcttgtcggtgccttcggagaaggcacgcgccatgatcgtggcgacgccgtcgaggctcgccggctcggcgtccaggggtgcgtcgaggagcacctcgacggcgacgacctgctggccggggcgctggcagcgcagcacggtcaggccgttgtcgagcgtgccgcgctcgggcgccgggaacgcccagggcctggcctcgccggcctggggctgcgggtggaagtccatggtcgcgagctcgttcacttcgccgactcctcgttctcgtcggtggtttcggcggcttccacgtcctccgcctcggctgcgacgggctcgtacacgagcaccgcgcggttgtcggggcgcaggcgggccttggcgacctcctggacctcctcggcgctgacgtcgagcacgcgctggacagcggtcagggcgagctgcgggtcgccgaacaggaccgcgtagcggcacagttcgtcggcgcggcccgcgaccgtgctgagccggtccagccactcgcgctccaactgggcctgggcgcgctccatctcctcggccgtggggccctcctcggcgaaccgggccagctcctcgtcgacggccgcctcgatcactgggacctcgacgtcgccggacgtcttcacgtccagccagcccagggagggcgccccggcgagccgcagcagaccgaagccggccgcgacggccgtacggtcacggcgtacgagccggttgtagaggcgggaggactcgccgccgccgaggacggtcagcgccaggtcggccgcgtcgcacacgcgcgtgccgtcctccgggaggcggtaggcggccatcaacgcgcgcgcggggacctcctcctcgacgacctcgcgcagctgctcaccgatggtgtcgggcagcgagccgtcgcgcggctggggcttgccgtcgtgtgcggggatggacccgaagtacttctcgacccaggcgagcgtctgcttcgggtcgatgtcgccgacgaccgacaggacggcgttgttgggcgcgtagtaggtgcggaagaactcgcgcgcgtcctgcagcgtcgccgcgtccaggtcggccatcgagccgatcggggtgtgatggtacgggtggccctcggggtacgcgagggcggtcagcttctcgaaggcggtgccgtacggaacgttgtcgtaccgctgccggcgctcgttcttgacgacgtcccgctggttctccatggactcgtcgtcgagggcggtgagcagggagcccatgcggtcggcctccagccagagggcgagctccagctggtgcgcgggcatggtctcgaagtagttcgtgcgctcgaagctggtcgtgccgttgagcgagccgccggcgccctgcaccagctcgaagtgaccgttgcccttgacctgtccggacccctggaacatcaggtgctcgaagaggtgggcgagacccgtacgccccttgacctcgtggcgcgagccgacgtcgtaccagaggcacaccgccgccaccggggtctggtggtcctcggagagcaccacgcgcaggccattggccaggcggtgctcggtcgctgtcaggccgccggagcctgcctcagctgtggccgtgtgacccatgggcatgtacgtcccttcgatcgcggatgcttctgtggcacaccgcagatttcctgccggtcctgccactgtatgcaagcgcgcagacaggtgccgaagttcccgcgcctcgtacgccgagagcgagactcgggtgtgcggtgcaggggaactcggccacgccggggacggcccgggcgccgtgttgacgaggcctgccggaagccccctggaagccgtacggacgggtcgtggtccgcgttgtcagtggggcggtccacaatggaccgcgtcagatcccgttcatgttggtgaaggagccgcagcagcgatggcccgccgcagcacgaagaccccgccgcccgacgacttcgaggagaggatcctcgacatcgacgtcgtcgacgagatgcagggctccttcctcgagtacgcgtactcggtcatctactcccgtgccctgccggacgcccgcgacggcctcaagccggtgcaccgccggatcgtctatcagatgaacgagatgggcctgcgccccgaccgcggctatgtgaagtgcgcccgcgtcgtcggcgaggtcatgggtaagctccacccgcacggcgacgcgtcgatctacgacgccctggtgcgcctcgcgcagccgttctccatgcgcctgcccctggtcgacggccacggcaacttcggttccctgggcaacgacgacccgccggccgcgatgcgttacaccgagtgccggatggccgacgcgacgtcactgatgacggagtcgatcgacgaggacacagtcgacttctcgccgaactacgacggccaggagcaggagccggtggccctcccggccgccttcccgaacctgctggtgaacggctcgtcgggcatcgccgtcggcatggccaccaacatgccgccgcacaatctcggcgaggtcatctcggccgcccgccacctcatccgctacccgggcgccgacctcgagacgctgatgaagcacgtcccgggcccggacctgcccaccggaggccggatcgtcggtctcaccggcatccgcgacgcctacgagtcgggtcgcggcaccttcaagatccgcgccacggtgtcggtggaggacgtgacggcgcgccgcaagggcctggtcgtcaccgaactgcccttcaccgtcggcccggagaaggtgatcgccaagatcaaggacctggtcggttcgaagaagctccagggcatcgccgacgtgaaggacctcacggaccgcgcgcacggcctgcgcctggtcatcgagatcaagaacggcttcgtgccggaggcggtcctggagcagctctacaagctgacgccgatggaggagtccttcggcatcaacaacgtcgccctggtggacggccagccgctcacgctcggcctcaaggaactccttgaggtctacctcgaccaccgcttcgaggtcgtacggcgtcggtcggagttccgtcgcggcaagaagcgcgaccgtctgcacctggtcgagggcctcctcgtcgcgctcctggacatcgacgaggtcatccgcctcatccgctcaagcgacaactcggcgcaggcgaaggagcgcctgatcgagcgcttctcgctgagcgaggtgcagacgcagtacatcctggacacgccgctgcgccggctcaccaggttcgaccgcatcgagctggagtcggagcgcgaccggctgaacggcgagatcgacgagctgaccggcatcctggagtcggacgcggagctgcgcaagctggtctccggcgagctggccgcggtggccaagaagttcggcaccgaccgccgtacggtgctcctggagtccgccgggtcgacggccgccaccgtgccgctccaggtggcggacgacccgtgccgtgtcctgctgtcctcgacgggcctcctcgcccgtacggcgaacggcgcccccttcggggaggacgccgacggcaggcgcaccaagcacgacgtgatcgtgtcggcggtcccggcgacggctcggggcgaggtgggcgcggtgacgtcctccggccgtctgctccggctgaacgtgatcgacctgccacggctgccggagaccacatcggcgcccaacctctccgggggcgcgccgatttcggagttcctctcctcgctggagggggacgagacggtggtctgtctgacgacgctcgacgagtcctcgcccggcctggccctgggcacggaacagggtgtcgtgaagcgcgtggtccccgactacccctcgaacaagggggagttggaggtcatcacgctcaaggacggcgaccggatcgtcggcgcgatcgagctgagcacgggcgaggaggacctcgtcttcatcacggacgacgcccagctgctgcgctaccaggcctcccaggtgcgcccgcagggccgtgcggcgggcggcatggcgggcatcaagctcacggacggcgcgaaggtgatctccttcacggcggtcgacccggcggccgatgccgtggtcttcacggtggcgggctcgcgcggcacgctggacgactcggtgcagaccacggccaagctgacaccgttcgaccagtacccgcgcaagggccgtgccacgggcggcgtgcgctgccagcggttcctgaagggcgaggactgcctgtccatcgcctgggcgggaccggtgcctgcgcgggccgcgcagaagaacggcaccccggcggagctgccggagatggacccgcgccgcgacggctcgggtgtgtcgctggcgaagacggtggcggtggtggcgggaccggtgtaggcccgctgcggatcagccggcctgctcggcctcggccgtctcctgccgttgctcctgctcctgctcctgctcctgtacgtagcggaggacgccccacatgctgtgctcgtcggcgtgtggggcgtcgttcgtgcacgcgtccagctccttgtgcagggcggccgtgtcgatgccggacccgatgaggacgagctgggtgaggcgggggccggcgggcgcccagggctccgggtagaaccgcaggaaccggccgacggcatgcacggcgtaccggttgcgaggatcggcggtgccgaagtcgacgtaccccttgatgcggtacagcccctcgggcctgctgtcgaggaagtccatcatccgacgcggattcatgggcgcttcggaggtgaaggagacggagtcgtaggcggcgtgcaggtgaccgtgatggtcctcctcaccgcggtgttcgtgcaggtcgtcgaaggaaagctgcccgatgcgctcccccgtgggccggcagtcgaagaggagctcggggtcgacccggccgtaggtggcgggcacgacggcggctcggtcggtgagtgagcggacggcccggagcacccgctccccgtcatccgcccgatcgatcttgttgacgacgacaagatcggccatggcgaggtgccggtcgacctcgggatgcttcgcgcgcgtggcgtcgaactcggcggcgtcgacgacctcgacgaggcccccgtacacgacccgcgcattctcactggcgagcaccatgcgcaccagctcctggggctccgcgagcccgctggcctcgatgacgatgacgtcgacacgcgcggaggggtgcgcgagccgctccaggtagaggtcgagttcgccggcgtcgacggcacagcacaggcacccgttcccgagggagacggtcgagtcaccgagagccccggcgacggccatggcatcgatctcgatggcaccgaagtcgttgacgatggcaccgatccggctccctccgctgcgatggaggaggtgattgagcagggtggtcttgccggagcccaggaatccggcgaggacgacgaccgggatctgctgcggactcgacgactggctcaacgtgcgccccttctcacaccggtgcgtgcgccggctcgtgtaccggcggacgctcgagagaggctcatggctcggctcgcgccgaatggggccggctctcgtacgacgaattactgccgacccaggatacgagcgggtggaaacaccgcgaagtgaacgattgttagcggcgctcgcggggcacacgttgggcatggcgccgggaaacgcgacccacacatccctccgtgcgcctcctctccgcctccctgccgatcagagccgctcggcactctgggagacggcaagcgcgccgcccaccgctcgccggtccccatatccgtcgccccgcacccgacgaccggcggatggtcgcctgaatcgggggttgacatggccacacagaactctgggatgcggaggctcggctccgccaccagggccaggctcgcggtcgcggtcagcgcggtcgtggaacgcagcacgcgccagcgtcggcgcgccgtactcaccgaacagcaccgcctccacttcgacctgctgtgcaaggccatggacgaccctgcgctggcggcggtcctggatacgtacgagcgcgagatcccgccggagacacagcgccagtacctcttcgcgaacgctctgtacgtcaacgccctgtacttccaccggatcggcgctctgaacctcgtcgaactccacggacaccttcgcgtgatctgccgcaaccggatcttccgtgagtactggaccgccacgcagcaccatcgcgagagcctgcccgattcgtccgaagaggccgcactgggtcggatgaccgagggtctggtgcaggaattgaacaacttggccgacgacacggacgacggcgatctcgaggagtggtgggtggtggggcaaccgccaggcgagtgacggttcagccgcgacccgcgtgtgcttacgagacttgggagacgcgtggggcacggagccgatactctgcccgcagcttgccccgggcaaacatcttgcaaggcggcactgttttgcgcagggctgcacccccacaaggacggcccactcatgagcatccgtgggcccactcatgagcttcactggacgcgagagaaaggtcatcagcccgcgcagcgtccggcgcgccctctcggcccgtccctcgaccgacctaggaacggacttgaagatcgtgcgtcgagtcggcgcctcgccccgggagcgcgggagcgcttcggggcagacctgccccgacatcttcgaactcagcgacggaaacttcgctgtcatcggcaccgaagccacagctgaccttgacggcgaactgccgcccgacgcagcgcgcgcagagtacgaacgcatcgttgtcatcagccgcgagacgctggtgcgagccaaggcggacattccggatgcgtgattgaagttcttctctcactttgccgcaacaggcctcgatgctcacgcgtcgaggcctgagccatgcgaccgtcaaaccatcagtggcaccgccaccggcggtaccggccccacataccgggccgccggtcggatgatcttcgggtcctccgcctgttccaggatgttggcgctccagccgaccacccgggccgccgcgaacgtgggagtgaacatctcccgtggcaggccgcagagttccatgaccacgcccgcgtagaactccacgttcgtgtggagttcacggcccggcttcagttccgcgaggatcgcctccacatggcgttcgacctcgaccgcgaagtccaccagcgggccaccgaactgctccgcgacgccgcggagcatgcgggagcgggggtcctccgtgcggtagacggggtgcccgaagcccatgatgcggtcgccggccaggacgcgctcgcgtatccaggagtcgatgcgctcgggcgtaccgatcgcgtccagggtgtcgagggcccggctgggcgcccctccatggagcggcccggacagcgctcccaccgcgcccaccagggccgccgccacatccgcacccgtcgatgtgatcactcgggctgtgaaggttgatgcattgaatccgtggtcaatggttgagatcaagtactgctcgatcgccctggtcctggccgcgtccggctccgagcccgtcaacatgtagaggtagttcgccgcataggagaggtcctcgcgaggctccacgggatccagcccctgcccgagtcggtacagcgccgtcaggagtgtgggcacggcggccgatgccatgacggtgtcggcgcggcgctgttcccggtcgatgtcgtacaccggccggaaccccttggcggcaccgagcagggacagcgccgtgcgcagcccggcgagcggtccggagcggcccgcggcggcggccacggccggcagcgtggccctcaccccatccggcagccaccgcagcgccgcggtccgcgcggtgaagacggcccgctgctccgcgtccggcagttcgccatgaaccatcagatgccagacgtcctcgaaaccgcgggtctgcgcgagttcgacggccgagtactggcggtagtggtagaagccttccagccctctgacatcacccaatgaggtgtcggtgacgacaacgccggcaaggccccgtgggacgtcgacagaagtggatgcggcccggttgatcggcatgattcctccctgaacttgattcgactgtccatgcttgactcgatgtctgtcaatattgattggatcaatactcaccgtacagatacggtggcgtccatgacggaccacgaagccgcgcccacgcaccccgatcggcgactgagcaccaaagaggccgccgaactgctcggcgtgaagcccgagaccgtgtacgcctatgtgagccgcggccagctcagcagccgccgcgagcccggcgggcgcggcagcaccttcgacgccaaagaggtggcggcgctcgcccggcgcaacaggcgtgagccgagcgggagttcggccatcggcggcgagctgtccgtccgcacacggatcaccctcatcgacaaggaccggtacttctttcgcggcgtcgacgcgaccgaactcgccgcgcggcactcctacgaggagatcgccgagtggctgtggaccggtcggctgcggcccggagtcacctttgccgctccggacgcgtccgtcgccgtcgcccgccgcgccgtcgatgccctgcccgagcacagcggtccgaccgaccggctgcgcgtcgcgacgatcgccgccgcgaccgcggacccgctccgcttcgacctgtccgaggacgcggtcctcggcaccgcacgcaccctcatccccaccctcgtggccgccctcccgcccctgcgccgcgaccaccgcgacgagggcccgctcgcccggcacctgtggggacggctcaccggccgcgcacccgacgcggcatcagttcgcgtactggacacggcactcgggctgctcatcgaccacgacctggccgcctcgacgctcgcggtccgtgtcgccgcctcggccagggcccacccgtacgctgccgtctcggcgggtctcggcgtgctcgagggccccctgcacggcgcggccagcggcctcgcgcaccggttgctcctggacgtcctggaccagggcagcgcagcccccgtggtcgccgacgaactgcgtgccggtcgccgtatccccggtctcggccaccggctctaccccggcgaggacccgcgcgcgcgtgctctgttcgccctcctggaagaggtacccgacgcggcccccgcccttgccgctgcccatgacgtcgtggccaccacggcccgccacgcgcccctgcacgccaacgtggacctggctctcgcggtcctcacggtctcctccggcatgcccgcctccgccggcgagaccgtcttcgccgtcgcccgtacggcgggctggatcgcacatgccctggaggagtacgaggagcgtccgctgcggatgcgcccgagtggccgatacgtaggggcgcggcctccgcaaccgctcccccggtagcgccttcacgcctccgctgcactcccgacgcgcccctgccgcgccccgtccgcgcggctggaagtcatcccgccccaagtcaggttaggctcacctctgtgagtacgtgcgcgaccgtgtcccgggacctcgacgagcccctcgcggggaccgcggcgaccgcgaggacatggctgctcctcgaacagcccggcccctggggcaccaaggcgctcacttcgagccacctggaccaggcgctcggccgcgctctcgaagcggccgccgaggggaccggcgtacggatcgcgctcatccgccgccccggccgccacgccgactgcggcacgccggccgtacgacaggtgtacgcggcccacacggttcccggaaacgtatggctgcacggcgccatgacgtccgatcccgagcagttgctcgacctcgacttcaccgcgctcggcatgggcgacccgcacaccttcgacagactcctagggggccgtccccacacgggcgaccccctcgccctcgtctgcaccaacggcaagcgcgaccgctgttgcgccctcctcggccgccccctggcagccgaactggccgcctccggagtgaccggcgcatgggaggtcacccacctcggcggccaccgtttcgcccccacgctgctgatcctgccgttcggctacgcgtacggccgggccgaggccccgcacatcaaggaggtcctccagggcgtacgcgaagggcgtgtggtcgtcgagggatgtcgcggtcgctccgcctgggagcggccgggacaggccgcggagctggcggtgcgtacggcggcccacgagtacgccgcggacgcgctgaccgtcgtcgccacggacggcaccgcaccacgctgggaggtcaccgtcgcccacgccgacggccgcctctggcgcgtcatcgtggcccagggcgcctcgctgccaccccgcccggaaagctgcggctcggcgctcggctccccggcgcgcatggacgtggtggcggtacgggagctgattcccacggagatcgacgccacgtcccgctgacgccgccgtgggcgcccgtcctcgcggtgagcgccccacctcagatgggcgaacgccgaaacccccgcataccgccgccccaccgctacgcggcgcacacccgcttatccgctgatcacagctctcacaccagcctcgcaagagatccatgccacaccccctacggcacggcgcgcccctccccgtaccgtcgtacacatgagccccactccccctgtacgacgactgcgcctgggtctgccccggcgggtgttctcgcaggtcctgctgatgcaggtgtcgatcgccgcaggtgtcgccgtactcgcgaccgggctgttcctcgccccgctcagcgcccagctggacgaccaggcgatgcgcagggccctcgcgatcgcgcagaccacggcggcccagccgcagatcgccgaggacttccaggcgacacggccgtcggtcggcgggcccgtgcagaccgaggccgagcggatccgtaaggccagcggggccgagtacgtcgtggtgatgaacatggacggtgtgcgctggtcgcacacggacccgacgcagatcggcaaggtcgtctcgaccgaccccagggaggccctggcgggcaaggacgtcatgcagatcgacaacggcaccctgggccgctcggcccgcggcaaggtgccgctgcgcaacgccgacgacaagatcgtcggcgcggtctcggtcggcatcgagtacgacagcgtgcgagcccggctgatcctcgccataccggggctgttcgcatacgccggcgccgccctggccataggcgcggtggccgcctacctgatctcccgaagggtgcagcggcagacgcgcgacctggcgttctccgacatctcggcactgctcgccgagcgtgaggcgatgctgcacagcatcagggagggcgttgtcgccctggaccgcggcggccgcgtacgcctcctgaacgacgaggcgcagcgcctgctcgggctcgacgcggaggccatcggtcagtcgctggacgacacgctcggaccggggcgtacgaccgatgtgctggccggacgcgtcacgggcaccgatctgctcaccgtgcgcggccagcgcgtactggtcgccaaccgcatgcccaccgacgacggtggcgcggtcgccacgctgcgcgaccgcaccgagctggagcaactgggccgcgaactcgactccacccggggcctgatcgacgccctgcgcgcgcaggatcacgaacacgccaaccgcatgcacacgctcctcgggctgctcgaactggacatgtacgacgacgccgtggagttcgtcggcgaggtggtcggcgaccaccggaccaccgcggagcaggtcaccgagaagatccacgacccgctgctcgccgccctgctggtagggaaggcgaccgtcgccgccgagcggggcgtggccctgtggatctcggaccgcaccctgctgcccgaccggctgatcgaccccagggggctggtcaccgtcgtcggcaatctggtcgacaacgcgctggacgcggtcgcgggcacaccgcacgcgcgcgtggaggtcgaattgcgcgccgagggtcgtacgacggttctcagggtgcgcgacaccggacccggaatccccgtggaacggcgagagttgatcttcacggacggatggaccaccaagaagccgccggcccacggcaaacgcggcatcggtctctccctggtgcgccgtctcgccgaacggcagggcgggagcgcccgggtggacgaggcggacggcggaggcgcggagttcaccgtcgtactgccggaggcgctcaccgaacccgctccggcaccggagacggctcctacggaggactctcttccggggaacacccctacggaagaactgattccggcgccggacacctcggcgccgaccaccaaggaggagtcgcgatgacccggccgatcgaagtcctggtcgtggacgacgacacccgagtggcgcgggtcaacgcggcctatgtacagaaggtggccggcttccatgtcgcgggcgaggcgcacaacgcggccgaagccctgcgccagatggagacactgccccacctggatctggttctcatggaccactatctgccggacgagacgggtctcgcggtcgtccaggagatgcgcaggcgcggccaccagaccgacgtgatcatggtgaccgcggcccgtgacatctcgaccgtccaggcggcgatgcggcacggcgcactccagtacctcgtcaagcccttcgccttcgcgggcctgcgcgccaagctggaggcatacgcggagctgcgtcgcacgctggacggcggcggcgaggccgaacaggccgaggtggaccggatcttcggcgccctgtcagcgggctcggagccggggttgcccaaagggcactccccgaccaccgcggagctcgtgcgtcgcgccctggtggccgccgagggccccctgtcggcccaggagatcgccgaacggaccgggctgagccgccagaccgcccagcgttatctgaagctcctggaacgcacgggacgggccacactgaccctgaaatacggcgacgcgggccgcccggagcatcgctacgtgtgggcgacccgcgtctgagggcccggtccgggccgagggctccggctcagccggtgaccttctcgacgaactccgtggtgtacgtcttgctcaggtcgatcttggcgttcttgatgttgggattgaaggccttgaggaccctctctaccgtctcgggaccgtccttgggcatcacgccgtcgtccgtgaacatcggcagcgtggtcttgatcgcccccgcgtagagcgtcttgttgccctgggagtagtcggcgggcatcttctcggcgatctgggacgcggtgtgcgtggacatccacttgagggtcttcacgaaggcgttggcgagcttctggacggtgtccttgtggctgttcacccactccgtctgcatgtagaggctcgacgacgggtacggaccgccgagcgcctccttcgacccacgcggcgtacgcatgtcgatgagtaccttgccgaggttcttcgccaggatgttggcgaccgtcgggtccgtggtcatgccgccgtcgatggaacccttctggagggcggagatgaaggtcggccccgcgccgacggcgaccgggctgaactcgctgacgctgacgccgttcttgaccgccaggtatttggtgaggaagtcggtcgaggagccgagcccagtgatgccgagcttcttgcccttgaagtccttgggcgacgtgatgtcgtcggcatgcctgttggagacgatctccacctcaccgggcgcatgcgagaactgcaccacggactccacgtccttgcccttggtctgcaggtcgagggtgtggtcgtagaagccgacggcaccctgcacctgtccggagacgagtgccgtctccgcctgcacgccggcgggctcgctcagcagctccacgtcgaggccctcggcgtcgaagtagccgagccgctgggtgagcatcgcgggaaggtagatgaccttgtccaggccgccgaccatgatcttgaccttcacgcccttgccgtcgcccttgctgccggaaccggacgacgcggtgctcgccgcgtcgttggcacaggcggtgagggaggagagagcgagcaggccggccgctgccagggcggtgtatctggcggtcatgcgcatggtggttcacgtccttgtgagaaggcggtgcgggaggtggtgcggggaaatgggtgccctgaagagggcgatcagcgaaacaggtgtcctggagaggcgatcagcgaagtggggcccctgaagagggcgatcagcgctcggaatccgacggcttccaccggaagatgcggcgctcggcgaaggtgagcaacccctcggcgaccagcgcgaccacggcgaggatgaccatcgcggcgtacacacctgccgcgttgaaggtgccctgggactgcgcgacgagcagaccgatgcccttggtggcaccgatgtactcgccgacgatggcgccgatgagcgcgaagccgaagctgacgtggaggctggtgaagatccacgaggtcgccgacggaatgacgacctgaagtgtcaccctgcggtcgctggcgcccaggatgcgggcgttggcgaccaggttgcggtcgacctcgcgggcgccctggaaggcgttgaagaagaccgggaagaacacgaggaccacggccgacgcgaccttggaggccggcccgagcccgaaccagatcacgaagatcggtgccagcacgatcctcggtatggagttgagcaccttgatgtatggaccaaggacatcggcgagcaagttgatgcgcccgagcgcaatgccgaagacgacaccggccactacgccgatgacccagccgagcagcgcctcatggagcgtgaaccagatctgctcgcccagggagccgagcgcggtgccgtgggtgacccaggtgtagatctggtcccagatcttcgagggcatcgagaagttgaaggggtcgatgaccttggcccgggcgcacgcctcccacagaccgagcacggccaccaggagcagggcccgggcgagggtgatgacgaccttgcgtctgcgggcggcacgcgcgcgtgaatgcgcgcggcccgtcttggtggtctcggtggcggtcaccgcgacgacggccccgggcatgaggtcaggcgacatgggcggcacccctctcacgggtgatgcggacctcttcgccgagggacgaccagatctcgcggtagatctcgatgaaccgcggctccaggcgcaccgattcgaccttgcgcggccgtggcagatcgatgtcgaagacctgcttcacggtcgcgggacccgcggtcatcacgacgaccttgtcggccagcgcgatggactcctccaggtcgtgggtgacgaagacgacggaggcacccgtgccctcccacagctccagcagctcgtccgacatcagtgccctggtctgcacgtcgagcgccgagaaaggctcgtccatgagcaggatctgggggtcgttgacgaaggtggcggcgagggcgacgcgcttgcgctggccgccggagagctggtgcggatagcggtcctcgaaggccgtgaggccgacccgggccagccactcgcgcgccttctgcttcgcctccgccttcggtacgccgcggaaccgcgggcccgccatgacgttggacaggaccgtacgccaggggaaggtggcgtcctgctggaagacgaagccgaccttgtcgccgacaccggcaaccggctcgccggtcaccaggacttcaccctcggtgggctcttccaggccgctgacgagggtcagcgtggtcgacttcccgcaaccggtggggccgacgacggccacgaactcgccacggccgacggtcaggtccagttccctgacggccgtgtgcagccccccggacggggtcttgaagatcttgctcgcgccccgcagctcgatggcggggctggtgtctgcgctcatgggccgggaccgtagatgtggcgcgggccacagcatcagtcttctgggcgcaagggcttcttctgcttgcaagagtctgttgtgctcgttttgctcgcgctacaacagcggagccgaaacacgggcttaacagctcgccaggccttgagagaaagaggcccgatgattgacgtcctggtcgtggacgacgacttccgtgtcgccgagataaacgccaagtacgtgggaaaggttcccggcttccgggtggccgcccgcgcgcacagcgctgcccaggccctggccgcggtggagcgcgcgcccatcgacctggtgctgctcgaccactatctgcccgaccagacgggtctcgagctggtccaccgcatgcgcgaacgcggtcacggcaccgacgtcatcatgatcactgcggccagcgacgtgacgaccgtgcaggcggcgatgcgtctgggcgccctgcactatctggtcaagccgttcaccttcgcggcgctgcgcacccgcctcgactcgtacgccgccctgcgccgcaccgtcgaccgtgtgggcggccggggcgtggcgggacaggagcaggtcgaccgcatcttcggcgccctgcgcacgacaccggccccgtcgtcgcccgggctgcccagcggccactcggagccgacgacggacctgatctgcgacgtcctccaccaggccgatcaccccctgtcggcccacgaggtggccgccgagacgggcctgagcagatccacggcccagcgctatctgcgtcacctggaacaggtgggacggctacggctctcactcaagtacggcgacaccgggcgaccggagcaccggtacgcgtgggtggcgccgtagaacgatcgcgcacgccccctggcggcgccgggcgccgtcagaccgcaccggcccccgtgagcgaccgcacctcggcctccgcgtgcttcgcctcgtccgccggctccaccgaagtgaccgtgccgagccagcccgcgaggaagcccagcgggatggacacgatgccggggttctgcaaggggaagtactggaagtcgacgcccgggaaaagcgattcggggctccccgtcaccaccggagagagcagcacgagccccagcgcgggcaccaggcccccgtagaccgaccacaccgcgccacgtgtggtgaagctgcgccagaacagcgaatacatgagcaccggaagattcgcggacgcggcgaccgcgaaggccaggcccaccaggaaggccacattgagatcccgggcgagcagtccgagggcgatcgcgaccacgccgacaccgaccgccgcggtccgtgcgacggccacctcgctccgcggcttcgcatgccgacgccgcagcgacgcgtagagatcgtgagccacggacgccgaggaggcgagcgtgatcccggcgacgaccgcgagaatcgtggcaaacgcgacggcggcgacgatcgcaaacagaaccgttcctccggtggaattcgtcccaccgcccagatcgagcgccagcaacggaaccgccgtgttccccgccgcgttcgacctgcgcacggcctcgggtccgacgatcgcggccgcaccgaagcccagcacgatcgtcatcagatagaagccgccgatgagcccgaccgaccagacgaccgagcggcgcgcggcgcgtgcggtcggcacggtgtagaagcgggacaggatgtgcggcagccccgccgtaccgagcaccagggccaggcccaaactgatgaagtccagccgcgcggtccagtccccgccgtacttcagccctggcgcgaggaaggcctcaccgtgcccgctgcgctccatcgccgtacgcagcaattggtcgaagtccccttggaaccgcaccagcacgagcacggtcagcgcgatcgtgccgctgagcagcagcaccgccttgacgatctggatccaggtggtggcccgcatccctcccatcgacacatagatcaccatgagcgcgccgacgccgatcaccgtccaggcgcgcgctgccccgcttgaacccccgagcagcagcgcgaccaggctgcccgcccccaccatctgcgccaccagatacagaacggacacggtcaccgacgaagttcccgccgcgatgcgcaccggacgctcgctcatccgcgccgcgaccacgtccgcgagggtgaagcgcccgcagttgcgcaccagttcggcgaccaagaaaagcaccaccaaccaggcgaccaggaagcccaccacatacagcagcccgtcgtacccgtagagcgcgatgagccctgtgacccccaggaaggacgcggccgacatgtagtcgcccgcgatggcaaaaccattctccatgggtgagaacaggcgcccgcccgcgtagaactcctccgccgaaccatgccggtgacggctcacccacgtcgtgatcgccagtgtcaccgcaacgaaaccgctgaacagcagcagcgccagcgtctgatgatggccggtcacagctgaccacctcccgcactccgcgtcagctcctgggtgtcccagcgcaggtcgagcgcggcccggtccctgcgcagccgggcgtgccgcgcgtacgcccaggtgaacaggaacgtggtgaggaactgaccgagcccggccagcaggcccacgttcaccgagccggccacggggcgcgccatcagcccgggcgccgtcgtagcggtcaccacatagcccacgtaccaggtgaagaacacgatcacgcctggaaccacaaatctgcgataccggctgcgcacctcctggaaggcagcgcttcgctgcacctccagatagacgtcggccgcaccacccacccggccctcgtgctcccggcgcgcgggcggcaccacgggagcgggcgcccccgtactgtccaactcgccccagccggaggcgagcgcgtcgtaccaggggtcgtcgaagccgacctctccggcgtcgcggccgtcctgcttctccaccgaactctccttgtccgcagcccgtttcggccacgtgcccaaggatggacagatcgggaagatctctgactcttctccccgcccacttcaccccatcaggtgacttactcggcggggggccgcacaagtcccttcccataggcgtaacggaccgcctgagcacggtccttgagtcccgtcttggcgaagagattgttgatgtgggtcttcaccgtggcggtggagacatggagcctgcgtgcgatctcgtggttgctgaggccctcggcgatcagcacgagcacctctgcctcccgtgcggtgagcccgtccggtacctccgaggatgcggcctgtccccgttccggctccgacagccgctccagcaaccgccgttgaatactcggcgagagccccgcgtcccccgacagcacgctctccacggcccgcacgatctcgtcgccgcccgcgtccttggtgagatagccacgagcgcccgctctgagcgccggaaacagtgactcgtcgtcggcgtacgtggtgagcacgacgacctgggtcccagggtgctcggcccggatccgccgggtcgcctcgacaccgtcgcagcgtggcatccgcaggtccatcagcacaacgtccgggttgagttcggcgaccagcttcactgcctcgtgcccgtcaccggccgcgccgacgacctcgatcccgggcagcaaccccagcagcatgacgatgccctcgcgcaccacggtctgatcgtccgccaccacgacccgcgccggcttccggctctcctcctccgtcatgcaggcaccttcagcgtcaccacgaaccccttctcctcccggccggcctccaacgagcctcccagcagctccgcacgctcccgcatgcccagcagaccgtacccggcccccgagccggtgagatcgcccggcttcccgcccgagtcccgcacatgcagcgtcacttgacgctcgccgtactccagcttcacctgcaccttcgcgcccggagcgtgcttacgaacatttgtcagggcttcctgtgcgaccctgcgcaccgcctgcgaggcctcggccgtcaaaagccgccgctcacccgagacggtgacgtccgcgccgtcctcgaaggcgacgagctcgctcaggaagtcctcgagcggggatatctcgccccgcagcgcggagagcgcctgccgggtctcggcgaggccctcgcgcgccatcccgcgtgccgccacaacccgcccgagtatctgctcccggtcggctcctcgctcgatcagcaacctggccgcctccagatgcaccagctgcgccgagaggctgtgcgccagcacgtcatgaatctcccgcgcgatcctggctcgctccgccagcgccgccgactgcgtctcggccgcccgcgccgcgcgctcctgagcgagcagacgctgggcgctcccacgagcctcggcgtcgagacgcagcacatacccggcgagaaatagccccgcgatggtggcggcggtggtcagccacacatcgttgtcgaccgccgcatacgccgccagggcagctgtggtcacgggcagggcggccgcgagaggaagccgctccagcgcactgacggcacacccgcaccagatgacgagggcagggacctggaagccggcggtctgcgccacgatcgcgattccgagaagcaccgcgatcaacgccagcgacggccagagccggtgctgaagtgtggtgcggaagaaggcccaggaggcgcctgcggccaggagcacacccgccgcggctgcgaccgcaccccagccgtgcacgtggctgctgctgaaggcaccccacagcagcatggcgaggaccagcgcccgcacggtccaggcgagcatgcgccgaggccgcgagagcccttcccgcccgagtgcctcacgggagggccagcgtgtccaggcgctctcggtcgtcacactcgctccttccgcgagggctgaggcacgctccacgagggctgggcgacgccgtcaccgtatgccctgctcccaccgtccgccggacccagggaatgcacccgccagatcaggaccccggagcggagcagcagcgtcgccgcgagggcgagaagcagcgcggggctctcctggcgcacgccgaggagcacaccgaggccgaacagtccgacgcgcaggactatgccgacgatccacacccccacgctcgccttggtgctcttgctccacacggtgccgtccgcgtccgtccatatccgggtcgtccaagcccagccgacgccggtggcgacgcctatgagcagttcggcgccgagcagtatccccgaccccgtgcggtggtgggcgtcgagcaggccgggctcgcgcacggccaggaaagcgagcacggcgggaacgatccaccagcgccggtccgcgttgatcttttgcatgcggaactgccgggcgacgaccagcacgacgacggcgaggatcaggagggcatgggtgagcccggacatcacggcctccgtggcgaacgagaacggatgccgacagcggctgccgtcgacaccttcgacgctacggaaatcggcaggtcagcagatcggagccggggtggatcgtgggtggatccctcagtgagacggttctccacccgcgggtggagaaccccgacggacaccgtcggcggccagcgcagatggccctgctcacctgcgctggggctgtgagcgagggtggggccacccaccgggaccgacgggacaccatccagccccgacccgctccgagtgcaccgagcgggaaccgggacccgcgatggcctacgcgtcgattcgcgaccgatccaacgtggccgccgaactggagatgaactccttgcgcggagccacatcattgcccatcagcagatcgaacacctgctcggacgcttccagatcggaaatgttgatccgccgcagagtacggtgccgcggatccatcgtcgtctctgccagctggtccgcgtccatctcgcccagacccttgtaccgctggatcgagtccttgtagcgcacattcttgcgctgcaactccagcagcgtctcccgcagctcccggtccgagtacgtgtagacgtacttgtcctgccccttcttcggctggctgagttcgatccggtgcagcggcggaaccgcggcgaacacccgcccggcctcgaccatcggccgcatgtagcgctggaacagcgtcagcagcaggatccggatgtgagcaccgtcgacatcggcgtcgacgagaagaatgatcttcccgtagcgcgccgcgtcgatgtcgaaggtccggccggaccccgctcctatgacctgaatgatcgccccgcactcggcgttcttgagcatgtccgtgaccgaggccttttggacgttgaggatcttgccgcggatcggcagcagcgcctggaactcggagttccgggcgagcttggcagtaccgagcgcggagtctccctcgacgatgaacagctcgctgcgctcgacgtcgtcgctgcggcagtccgcgagcttggcgggcagcgaggaggactccagggccgtcttccggcgctgcgcgtccttgtgctggcgggccgcgatgcgcgtacgcgcggcggcgacagccttctccaggacgacccgggcctgtgcggcggcatcccgcttcgtggaggtcaggaacgccttgagttccttggagaccacattcgtcacgatgcgacgggccgccgaggtgccgaggacctccttggtctgcccctcgaactgcggttcggcgagacgcaccgtgaccacgaccgtcagcccctccagggcgtcgtccttgacgacgtcgtcctcggcgacgcgcagcagcttcttggcacgcaggacttcattgaccgtcttggtgacagcctgctcgaagccggcgacatgggtgccgcccttcggggtggcgatgatgttcacgaacgacttcagggtcgtgtcgtagccggtgccccagcgcatcgcgacgtccacgccgagctcacgggtgacctcggtgggcgtcatctgaccgtggtcgtcgaggaccgggaccgtctccttgaaggtgccctgcccggagaaacggaggacgtcgcacactggcttgtcagtggccaggtactcgcagaactcgctgatgccgccgtcgaagcggaacgactcctcgcccttgctgccgccctccccgagcccgtactcgtccctgacgacgatggtcagacccggcaccaggaacgccgtctggcgggcacgctggtggaggttctccagggaaagcttggcgtccttgaggaagatctggcggtcggcccagtagcgcacgcgcgtaccggtccgcgtccgggggatcttcttggccttgcgcaggccggcggtcgcgtcgaacttcgcatccgggccgaccgtcgcgaaggcgcccgggacaccccgccggaagctgatggcgtgcgtgtgcccactgcggtcgacctcgacgtccaggcgcgcggagagcgcgttcaccacggaggcgcccacgccgtgcagacctccggaggccgcgtacgagccgccgccgaacttgccgcccgcgtgcagcttggtcatcacgacctcgacgccggagaggccggtcttgggttccacgtcgaccgggatgccgcggccgttgtcccgcacctccaccgagccgtcgtcgtgcaggatcacgtcgatgtggtcgcagtaacccccgagagcctcgtcgacggagttgtcgatgatctcccagaggcagtgcatcagcccgcgactgtcggtcgacccgatgtacataccggggcgcttgcgcacggcctcgagcccctcaaggacgagcaggtgccgcgcggtgtagttggaaccgtcccggtctgctccggtcagcagcgctgtggacggcacggacgtatcggcggtcacgcggttcgctcctcgctgaatttcaggtggggcccttttgggtaagggccgggcttcggtcgccgctccgagggtaccgaggcctggtagagccgttgtaacgccaccctcgtctgaactcacactagtccagcgtcgtacgagcgttcgatccctcgatggagtgaagtacatatcacgttcccttccgggcatgaaccatttaggctccgggcacgtcctcaacaacaaccggcaacccagccgggaggaccaacacctgacaaacagcgcgaacccgtaagacacacagacacgcaatacggcacattcgccgccaaccggcagcaatcagccggcccggaaagaaattttcagggagaagccgcgagcgggaacgttttcggcctggttggatgttgaccctggtacgacagctcgtcgagctagagaagaggcgacgtgactactgttctgacccccgcgagcccgctgacggccgctgaccgctgcgaccgttgcggcgcccaggcatatctgcgcgtcgtcctcctgagcggcggagaactgctcttttgcgcccaccacggtcgcaagttcgagccggaactcaagaagatcgccgctgagatacaggacgagacggagcggctcacgacccctccggcaagcgccaacgacgaagagcgttgacacttcgcatcaacgacgagcgagtgccggcctcgtagccggtgagcgggcgaccaccccctggacacagggagtggccgcccgcactcgtacacggaaccggttcgcccgtggctgcgcccggcggcccggcccgcgtccgcacgccctgtaggcaccaggagggccaccggcgcctcgtacccgcgcaggcggcatacgacatgacacccgcacccgcagccccctcagcggcttcccacagcgagtcagcgactcctgccgaacgccctggcgacgtctgagacccgcgtgtagacgcccgggcttccgggcctcccacagccactcccccacgacaccagtccgatcagacgcccctgggcgaccagtggcccgccactgtccccctgacaggcgtcacggccacctgcgagctctccggcgcacagcatggagccggccagatactttccgtccccatcgccgggatacgcctcctcacaggcctcgtccggcagcacctgcacgcgcgcggcgcgcaggctgtgggcatagtcgccgctcccggtggcgtcgccccagccgtagaccacggcggccgtcccaggcgcgtaggccgggtcggccgaggaggccatggggatgacggagctctccggaagcggcgaggccagggtgagtacggcgaagtcgccggcgttcgtggaactgtcgtaatccgggttgacccaggtggcgcgcaccgggatctccttgccctgggtcgacagcaggtcggtccggtcggcgatgatcctcagatcgcgaatccggctcggcggcgcccccaggacggccgcgctcagacagtgggccgcggtgagcacagtggaccgggcgatcaccacgcccccgcagaactgccccgcccgcgtacctccgaaccggtcacggctggacagtgcgaccgtccacggactctgggcggtctcgaccggatagccgccgatgacaatgctgtcggccgtcgcgggcgcgggggacgccagcggtatcacggccgctgcggccccaagggccagcgctcgggcgaagggacgacgcatacgcgctcctcactcaggggtggtcatggaatacccagagtgatccagctcatcacgtcgcgcatacgcagcagccgacggcctccacatgctcggtggacggcgcgcacatgctgagggcccggctccccacggaagccgggccctcaggtgcgtacagccgagacctagtcgaggtagtcgcgcagcacctgcgaacgcgacgggtgacgcagcttcgacatcgtcttggactcgatctggcggatgcgctcacgcgtcacgccgtacaccttgccgatctcgtcgagagtcttcggctgaccgtcggtgagaccgaagcgcatcgagacgacgcccgcctcgcgctccgacagggtgtcgaggacagagtgcagctgctcctggaggagcgtgaagctgaccgcgtcggccgggacgacggcctcggagtcctcgatgaggtcaccgaactcgctgtcaccgtcctcacccagcggggtgtgcagcgagatgggctcacggccgtacttctggacctcgatgaccttctcaggggtcatgtcgagctccttggccagctcctccggggtgggctcacggcccaggtcctggagcatctgacgctgcacgcgcgcgagcttgttgatgacctcgaccatgtgcaccgggatacggatggtgcgggcctggtcggccatggcgcgggtgatcgcctgacggatccaccaggtggcgtacgtggagaacttgtagcccttggtgtagtcgaacttctccaccgcgcggatcagaccgaggttgccctcctggatgaggtccaggaagagcatgccgcggccggtgtagcgcttggccagggagaccaccagacggaggttggcctccaggaggtggttcttggcgcggcggccgtcctcggcgatgatctccagctcgcgcttgagcttgggggcaagcttgtcggcgttggccagcttgtcctcggcgaagaggcccgcctcgatgcgcttggcgagctcgacctcctgctcggcgttgagcagggggaccttgccgatctgcttgaggtagtccttgaccgggtcggcggtggcaccggccgcggcgacctgctgcgcgggcgcgtcgtcctcgtcctcgtcggagagtacgaagccggcgttctcggtgccctcgggctcctcgccggccttgccgggtgcagcggtctcctcgaccgcctcgtcgtcgagcagctcgacgtcgtccttcttgccggtggtcttcttggccgccgtcttcttggcgacggtcttcttcgcgaccgccttcttggcggtcgtcttcttggcagctgccttcttggcggacgcgtcctcagccggatcgtcgccgacgggcacagccggggcggcggtggcggtcgccttcttggcagtcaccgtcttcgccgcgacggtcttggtggcggtgcgcttggccggactcttcgctgcgacgctctttcgggtgcgcttgggctccgcggcactgaccatcagcgtcacaccctcttcctcgaggatctggttgaggctgcgcagtacgttcttccactgagtggccggaatctggtcagcttcgaaggcccgacgcacgtcatcgccggcgatctgcccctcagcctttccccgctcgatgagcgccatgacagagacggactcggcgatctccggcgggagcgtacgggatgtgctggccgacacgaacaacctctcggaacgttggaaaacggcttccggccccgtccgtaacggacaggaaccgacgaccgccgacttggggatgggccgacggcgcgggtggggccgggaagatgcacagcgccgtaaacggcgtccgtattccctcctcggctgtcacctcttaggtcatcgcgcagtgccgaggagcgttacgcccaatccgcgtggcccgagtcacaccccgtaaccactcaaaaacgactagatgcggtcataggtggtcaacgatggccgctgcggccgcacgatccgagggtcggtggacttccgggccgccgaatcagcggttggccgccgggtcgctcgccgtcggacctcagcggctcccgggctccgtacgccgccgagccatgccgattcccggactccgcatgccgtcgaaccgcgccggtcccggaagacgtgccgtcgaaccccgtcggtcccaggagggtccgacggagcccggcgacacgtgcacggggtccggtgacagacggttcgccgtgcgggcgctgtcgggcccaccggccgggcgagagcgggcgagggcggtcggcccccgaccgcgccgcccacggcgcaccgtcagtgctcgcgcggcgcgggcaccacacgctccacctcagggtggacggtgagcaattggcgcatggccgcctcggcagccgcgccgtcgcccgcgcccagggcgtcgacgatccgggcgtggtgcgccagcgcggcctcgttggggcggtcgcagccggtgaccgggccgccggagacctgcagggcggccgacacgatcccggagaggtgctccagcatgcggttgccggcgacctggatgagcagggagtggaattccgcgtcggcgcgcgagaaggtcagggcgtcaccctgtgccatggcgtggcccatgatctcgaccatgtcggcgagccgctgctggacctcctcgcgcccgtggccggcggcgaggcgcgcggcgagcggctccatcgtccatcgcagctcgctcagctcgcggcgctggtcgtcgcgctgcggcccgaacgcccgccactcgatgatgtccggatccagcaggttccagtcgctgacggggcgtacgcgcgtgccgacgttcgggcgggcactcaccaggcccttcgcctccagcacacggagcgactcgcggacgacggtgcgggacacctcgaagcgctgaccgatctcctcgggcacgagcgggcggtccgcgcccaggtcgccggagacgatcatctgccccagctgctgtacgagttggccgtgcagtccgcgtccgcggctgcccgcggcacgccggccgacgcggcccagttccggatcggcgctctcccacgcgggaatgccgacgcggtcggcggcagaggcctcggcgtaggggtagcggtcgagttcgcccggtccggtcaggccggagtcggcggagcgggcggcggtcatcatggtgtgcgcaagggtactcacggatcctttgtcggcgtcgcttccaacgcccttgaggtctttggtgaaaagcacacgaaagggtgatcgctcaccccgtcgcaattgacgccttatcggaaagaaatgggcgttctccgggaagttgcgctcacgacaggaccggaagccctcggacggtcgtcatcggaccctgctacgcagggtcgtgagcagatatgcgcagagcagagcggtcagcgacaacatcagtgcactgcccacgggttgggcgaccacccgggccgcggcggccagataccgctcgccgccgaacggccactgcaccagcatcagctctcgcagccgcgtggcgaacccggccgccgtccgaacagacgggccttcgagcgccctttgtacgaggggtacgacgacgacgggtaccgccagcaccgcggcgagcccggcggtcgtggagcggaagatgcccgcggccagtacaccggcccaggcgcagcccaccaggagtccgagccaaccggcgcccagggaaagccagtcggtgggaacttgggtgagctcccgtccgtagacgaggtagagcacttcgagatcgcaccccacggcaaggaaggccagcagcagcgcggtcgccccggagacgaggagtttcgcggtgagcagccccaggcggcgggggacggtgccgcgatccgtggccagggcggggtggcggaactcgtcgccgaaggcgaccgccccgagcaaccccgcgccgagcgccgcggggggcagggggaagtcctgcggccacgcggccaggaggcggtgctgcggcgtgtgaccgattctggcgaggatcacggcgatcagggcggaggcgatcagcacggcagccgcggtgacgtagccggtgccgactccggcagcgcggcgcagctcgtagcgcaacggacgcagcggactgggcgcctggcggacactgatggggggcggcagcggggacaggtcttccgactccagcgaaccggccgggcggggcgggggagcggtcggctgcgtgtcgggggcggcccccatgtcaccggtttcgtcggccagttggtgtacgaggatgccgtgccggaaggcggtctcgccgacatcggcgcacgtactgccgtacaccgacagccgattgccgtcctcgcgcacgatctccacggagcgttgcccggttcgagcctccttggccagcagagcgccgagtcgggcggcgtgcgggctgcggactgccacgcggggccgcagccgggtgcgggcgaagtctgcggcctcctggtcggcgacaagcctgcccgcctccaacgtgacgacctgatctgcggtctgcgcggcctctctggggtcgtccgtggtgaacaggaccgtgccaccctgcgtggcgtgcgcacgcaggagaccgtgcagccaccggccttcgcgggcggacaggccgtcggcgggggcgtcgaggacaagggtgtgcggatcggccagcagcgcgcaggccagaccgaggcggcggtccatgccgcgcgaaagggtgctcaggcgttcgtcgcgcaggctgacaagaccgaccacctcgaggacttcatcggcacggcggacagggacgccggcggcggcgcacaacatacggagttgaccgcgcaccgtgcgggcggggtgaccggggacatcgccgagcaggacgcccacttcgcgcgagggatgggcgatgcggtgcagcgggcggcccctgaagtaggtgatgccacggccctgttggagttcgagcatgagcctgagcgccgtcgtcttgcccgcgcccggggttccgaggagcgcggtgacacggcccgcgtgcgcctcgaaggacacatcgtcgacgacgggcggaaggtccttgcgggggttgctggtcagtccgatcgcctggatcacccaaagcaagatagcgcgatatgtccggttttccgggcacctgagggcctccttcggacaccggcttcccagcggccggactcagccctctccgtccgcgccctgctcgggtttcagacctccgggcgcagcatcggcggattgagcagcgtggcgccgcccgcgcggaagagctgggccggacgaccgccctggcgcgtcgtggtgccgcccgtgggcacgaggaagcccggtgtgcccgtcaccttgcgatggaagttgcgcgggtccagcgccacgccccacacggcctcgtagacccggcgcagctcgccgacggtgaactcggtcgggcagaacgcggtggccagcgacgagtactcgatcttggaccgggcacgctccacaccgtccgccaggatctgcgcatgatcgaaggcgagcggtgccgccttctccccgtccctgccgtaaccgccctgctgcagcagctcctcgacgggcgcccagcgggcgctgttggcgtcgccgcccgccctgggcgcgggcaggtcgggtgcgagagcgagatgggcgacgctgaccaccctcatccgcgggtcacgcttggggtcgccgtacgtcgccagctgttcgagatgcgctccgttgtcctgtgcggaggggtcatgggcgcgcagcccggtctcctcggccagctcgcgcgctgctgcctgccccaggtcctcgtcaggccgcacgaagccgccagggagcgcccacctgccctgaaagggctgctcacctcgccgcaccgccagcgcacagagggcgtggcggcgcacggtcagcacgaccaggtccacggtgacagcaaagggcggaaaggctgacgggtcgtagggcatgccgcgatcatagtcgtctgcctgacgataaacactcccttcgtcggccgcatcggtggttgatccacttccttcgggctggtccgggggctcccggccatggcccagccgcatcgcgcgacgtcacgctctcaactgcaatccgtcggccgcctcctcgaccatggcgaggccgagccggctgacgcgcacggagaagggcgcgccggcgactctcagtcccgtcaatccgatctcgcccagtggggcactgcgcagcgggcgcagcgtcaccgtgccggccggggcgtcggggcggatccccgccagagcggtgaggagcagcacccctgaggccgcggcggtggcggccggtcggcaggctgcggggtgcggcagcggagagccggcttccgtgcgttgttcccccgcgtacatctcgggcagccgatgcccgaacgcctccgccgcggccagtacgccccgcagcagcgaactcgcctccttctcgtaaccggcggcggccaggcccgtgacggcgaccgccgtctcctggacccgcacggctcctcctcgatgaccgaacgggttgtacgccgcctccctcgctcccaggctgcgcagcccccatccgcagtccatggccggaccgccgaggagccgcgcgagttgctccgtccgcaccctgtcgagcaggccctgagccatgacaccggagccgagcaggccggtgtcgagaaggtgggcggcgcccgcgccgaggtggggcaccaggcgtccgtccggggcccgggcggccgccggtctgcctcccttcaggtcctcgatccagaagtcgtcccggaacgcggtgcgcagttccccggcccactggcgcagcccggggccgcctgggcggccgtgggcatcgagcaggtccgcgcccagcagcgctgcccgatgggcgtacgcctgtgtctcgcagcgcagcggcccgccgggctgggggtcggggaggtaggtaccgtcgccgacagcggtccgaagccactggagacagcgttccgcggcgggcaacaactcctgcgtctcctgctccggcaacccccagcgccgggcctccgcgagaagcacagggaagagcagggttgcctccgtgcccgtgcagccaggtggcagatgtgcgcccgcgtcccgccgtggtcccgggatcatgcccgaatgtgggcctggtcccgagagctggctgcgggcgagggtccgcagcgtgcccgcggcaagccgggtgccgaggggcagtgccatccgcgcggcgaccagtgcctccgccggagccaggccgcagcgccacggcgccccggctgcgagatgcgggtcggaagggtggctgggatcgcgcagcagcagagcctgcagatcctcgacgcaggcatggagcagcgattgggccctggggtcgtcgcccgtagccgtggcctgggcgagtgggctcgtcgcgccgcgtaccaccgctctgccggctccggccccgtccggccgtacccgcagttccacactccatgtgccgccgggtggcagctccagcccccagcgcagcagtccggcggaggcgagggcgtcggccggcggcggatccgcggtgacggccgaggtgccggtcgggccggtccagcgcaggcctgagtcgtgaacgctcgcggggagctcgggaccggggctgcccgaagccaccgtccccagatccgcgaggtccgtcccgagtgccacctcgacggacaggcgcaaggggcgtgaggcagcgctgtgcagcgtgatccgttccgtgccgtccgcgtgccgcgtgcgttccaccaggacgtccgggtccggtcctgcgtcgggggaggctcggagggcgcccacgaagcggacgcggtcggccgctaccatccgcgcttgcacggcgagcggctcccgccccgccacccgcacctgacagcgggagagcaggcgccgccccgagcggtagaacccgtccaacccctggccggtcagctgcccctgctccgtggagatcgccagccccggcagggccgcacagatcagcgcggtgtgggctggcggcaggtccgcggcgtggcggagtggtggaagcgggggtcggggagcgaagggtctgcccgccaacgggccggggcccgagggccggttgccccgcgcgggggtacccgatggcctggacgtcgcttcgggaatgaccgaccgtcggcctgcgcctgcgaaggaggtaggtgtcctctcctgagccatgcggggcgctgtcttcccgccgcccccggtcggtggcgccgatggatcgccacccggcatcaagggctttgtggatgcgcggcggggaggccggtcgccgtcgtgggcggcggacggagtgggcaaggacatgaggcggcttcttctgcgcctggcgcgccttgggcgcgaccggcgcctggtggggggctccgaaaggtcgtgggcgatgcgtcggcgcgacccggccacgggtaccgccacccaggtgaacggagtgggcctgcctcgggtcacgcccggcggccgggaagccgaccgaatggctgcgtcgcggggcgcaggtcacagtgccgaaggcggcttgacgccgactcgcggaccacgccgcgcagctgggtgtgctcatacgtctccctgcgcatcgctacgtgcggtgccaccgggtgcgtgtgaacgagtggtggcaccctctgccgcactccgcggtccttcggcggaacgccggagtccgtccatcgcggaccgtgttccgtcggcggcaggcccggtgccctcggctggacgcctgcctctgcgggcgaccgtcctgggagaacggcggctcggacggctgccaccgctcacggaacgcaccctgcgacggcgacggccgagaacaccaggcgactccccagttccgtcgccctgcccggccggagccgccggatcggcgctgtcgcccggcgtggaggggccggaccatcgagcgccttgcgaagctccaggatcttgtggctccagactccggggtggctgcgcggagcggagcgaaggcgcggtggcggccagtggcgcgggagggacactcccgtccgtcacggcccggccctctcgctccgcacgcaggcagcggcgaacggactccgggtccaggccctcgttgcaggcttgatggaggaggcgggcgaagagatagccagggtcggcgcccagggccatggccagggcttcgcgggcctccagttcgtcgccggaagaccaggcgacccacccagcgagcgtgaggggcgcggcagcgtgctcaccgtacgaaccgacgcagcggcgggccagggcacgccagaggcgcagggccggtgccgcttcgtcgtcttccatccactccgccgcacggtcgcgggtcgtccggtcctgcagaccgaggatcagagtggcggcctcctcgtgcccgaggagttcgtcgtcgcggaggtctgccgggagggtgccggacacgggcgacgtagcggtgaaccgtcccatcacctgccgggccagtccaagggtctcctcggcgacgtcctcccgggtctcgccgtcgaggatcctgggaacgagggccgtgctggcggcgtcgagggcgatctcctgcgccagggctgccgcggtctcccagggagcgagcctggccctgaactcccgcaggcttccccgtacttgcagacctgcgtacgttgcggcagcggcgagcacggaggtgccgggcagccccatcggccggccctcgggcggacagcagtcggggctcgggcagcagtacgaccagaagcggccgtcggagatgcacagcgcctcgaccacgggtacgtcgaggctgccgcaggccgtgcgcagcagctgagcgagcggctggagccgtgccacgacgtcgcaccccgtctcgccgctcgcaggctcctgacagaggtaggccaccatgctctccgggcgtacgcctctgcgctcacttcccgtcaccaggccgtgcgccagctgcccggccacggacgcccagtcgtccgaatgggcggggatgccgagcctcgccctcccaccgaacctgcctcgcccgtcctggtcgtgcagagcgaccagcacgatgctgtcctcgggtcgatacccgagcaagtaaggcagcgcgtccgccagttcggccggagtccgcaatgtgacctggcgctcaccgctcgggtccgtgtgttcggtgtggctgatgtacgcggtggactcgtcgtcgtagggggtgccgcccatctcggcgtccacagggcctgcgggtccagcgagatcatcacccgcgccagccgaggaccgctcgacgtcaccgctcgggtgggccgcggtccgagccatgtcgccgctctcctgggccgcaccccgccacatgtcgccgcccaccggggccgcgaccccaccaatgccaccgctcccctggtccgtggatccgtccgcgtcaccgctctcgtggtccgcgaatccgctcatgtcaccgttgccggacgtgccggccgcttcgtcgtggttcgtcatgccgtgaccatctcgcggatcttggaattccgcttgaacctgtggataaccatggccatgagcacgccaggagttgtccacaggccggctgcctcattcgcgcaatgtccgaccgatcgggttgcatggatgccatgagcgacgaagaccaacgacccgccccgtccgcagacccgcgccccgccccggacggagacctgcgtaccgcggccgatgccgtgctcgcccgcctcgtgggcgcgccgacgggcgaggcccggctgcgcgaggatcagtggcgggccatcgaggcactggtggcccacaagcgcagggccctggtcgtgcagcgcacgggctggggcaagtccgcggtgtacttcgtcgcgaccgcgttgctgcgcgagcagggcgcgggtcccacggtcatcgtctcgccactcctcgcgctcatgcgcaaccaggtggattcggcggcccgcgcgggcatccgcgcgaggaccatcaactcgtccaacacggaggagtgggacacgatccaggccgaggtggccgcgagcgaggtcgatgtgctcctggtgagcccggagcggctcaacaaccccgacttccgcgaccaggtgctgcccaagctggccgccgcgaccggcctcctcgtggtcgacgaggcgcactgcatctccgactggggccacgacttccggcccgactaccgccggctgcgcaccatgctcgccgacctcccgtccggtgtgccggtcctcgccaccaccgcgacggccaacgcgcgcgtcacggccgacgtggccgaacaactcggcaccggaggcggcacggacgcgctcgtgctgcgcggaccgctcgaccgggagagcctcagtctcggcgtgctgcgcctgccggacgccgcccaccgcatgggctggctcgccgaacacctcaacgacctgccgggctccggcatcatctacacgctcaccgtggctgcggccgaggaagtcacggccttcctgcgtcagtgcgggcacaccgtggcctcgtacaccggcaagacggagaacgcggaccggctacaagcggaggaggacctgctcggcaaccgggtcaaggccctggtagccacgtccgccctgggtatgggcttcgacaagcccgacctcgggttcgtcgtccacctcggctcgccctcgtcccccatcgcgtactaccagcaggtggggcgcgcgggccgcggtgtggagcacgccgaggtgctgctcctgccgggcaaggaggatcaggcgatctgggagtacttcgcctcggtcgcgtttcccccggaggagcaggtgcgacgcacactggacgtcctggcgcgggccgaccgaccactgtccctgcccgccctcgaaccgctggtcgaactgcgccgctcacgtctggagacgatgctcaaggtcctcgatgtcgacggggccgtacggcgtgtgcagggcggctgggtctcgacgggcgttccttggacgtacgacaccgagcgctacgcctgggtggccaagcagcggtcggctgagcagcaggcgatgcgcgactacgtgacgacgacggcctgccggatggagttcctgcggcggcagctcgacgacgagggggcggctccctgtgggcgctgcgacaactgcgccggaggccgattccacgactccgtgtcgtccgggtcgctcgacgcggcacgtggcgaactcgggcgtgcgggcgtcgaggtcgagccccggaagatgtggccgacgggcctgccggcggtcggcgtcgacctgaaggggcgtatcccggccggagagctggccgcgcccgggcgtgcgctggggcggctgtcggacatcggctggggcaaccggctgcggccgatgctcacgccccaagccccggacgggccggtgccggacgatgtcgccaaggccgtggtcggtgtgctggccgactgggcgaaggggccgggaggctgggcctccgcagggcccgacgcacagccgcgtccggtgggcgtcgtcacgatggcctcccgtacgcgtccgcagctgatccagtccctgggggcgcggatcgcggagatcggacggctgccgctgctggggtccatcgagtacaccggtgagttcgcgcaggtccaccggagcaacagcgcgcagcggctgaaggcgctcgacggggcactgaccgtgccgcccgccctggccaccgcgctcaaggaagccggcggtccggtacttctcgtggacgatgcgacagagacgggctggaccctcgcggtggccgcgcgcatgcttcgacgagccggtgcgtcgggggtgttgccgctggtcctggccgtacaagcgtgacccgcgcgtcgctgcggagcacattgggcagagatgtagcggggatatagccgacgcaccacatgaaaacgggctgtggccccaattgctcgttgccgcaaccaagttcgacaggaagaattgaggtccgctccccgcacggctcgtccgtggtccggtagggctctgctgcggcgtgcgctcccccaagtccgacccccgcccgcagtatgggcgcgtagccgaagggaggaccgtgaccttcggattcgcaccgtcctcggcggcatccatgtcgacctccgccgacctgtccgccgcttccgccaaccctctgacccggatgctcgaacccgcggagtgggccgccgcggggattccgctgctgcgcaatccccgggaggtcgtcagcgggctgcactcccggcaccggcccggcccggcaaccgccatcgtggccgtcctcgatccggaagaacggcttcaggcgagcgcctccttcacccggcgggcggccccggccgacggctggatgttccgcaacgcgctgctcgcgcagctgcgccgggtcatcccgcacgacctgcgacgccgtacgccggtccgcacggccgtgctgctctactgccgtgagggcgacgcgcgttggacggaggaggacggggcgtggatgtgggggctacgcgacgcgtgcacactccacgggctgcgctgcggggcgtacatcacactgacgcgtgacggctggcaggtcctgggcgagggccggggcggacgccgccccaacacggactcgccgccggaggctttcgaactgaccagcgcgccaccaccactgccgcgcaccggaggctccgcgtcggaggtgctgcgccgggcggccgcccgctgagcggccgggccccggcgtaccaccaggggcgtacgacagaccccgcaccgcgagttgcgcaagacagccactcgcacccaggcgatgggcacggcagcctgccgcaccaaaagtgcggcaggcctcacacaccacaagtgaggcagccttacgcattacgcgccacgcatcacgcatcacgcatcacgcatcacgcatcacgcatcacgcatcacgcatcacgcatcacgcatcacgcatcacgcatcacgcatcacgcatcacgcgaagggtgcggcagcctcacgccaccggcgacgcacgacagcacgcccggagacaccactcgcaccgcgagccggtgacacgcctgcgaaaacgtactgagggcacaccggggcaaccgccgtgcaggtgccgccgcagcggcaccctcaccgccccggccacaggtgtcccggccgggccccgtaccgcggcacgaaccggacggacggagtccgagcgcgtcgagacctacgaggcctcagcgcgatcggaccgcacggcggccgagcccgagtcgctcagaccccggcgcccagcaccgagttgatctgctgcgggtcgccgcagacgatcagcagggctccggcccggccgagcgccagcggaagcgcggtggcagcgacgccggcagggccgccgttgaccgcgaccacgaccaccggccgggacgcggcccggccgaccgcggaggcgtcggcgtagaagacgtcgtcgcccgcgtcgtgctgagcccagtaggcagcctcgccgaaggacagctcgtgcgcggcccacgggtgcggttcgccggtggtgaccaccagcacctcccccggggcacggcccgactccagcagcaggtcgacggcctcctcggcagcgtccagcgcgccctcgaccgaggccgggatcaactggatctgcggggtggcaggggtaacggcagccgccggagcggccggtccgggcgtggccacggccggatcgcgtggggtgcgttgggccggcatcggccggacgggacccggacggccgggccgcgacggagccgcgggacgggggccgggtacggggcggggggtcggcgcggtacggccactggccggagtggcgcggggaccctgggcactctcgtgaatctgaggctcctcgggaatgagaggcatgagctgctttttatcaaacgccggtgcggatcgcgtcggcgggtggcacatgagtgcgagcggaaacagtcagaaatcgaagccgagctggccctcgatttccggaacgcttccgtccgcccagctgcggaccttcttgaggtgccgccactggggcagcgcatcaagatacgcccacgacagccggtggtacggggtggggccccgctccgccagcgcggccttgtgcaccggtgacggatacccggcgttggccgcaaaaccgaagtctgcatgttcgatgcccagttcggccatcattttgtcgcgctgcaccttggcgatcaccgaggccgccgcaacggccacgcaggactggtcacccttgatcaccgtacgaaccttccagggcgacccgagatagtcgtgcttcccgtcgagaatgaccgcgtcgggacggaccggcaaggcctccagggcgcgtacggcggcgagtcgcagcgcggccgtcatccccagggcgtcgatctcctcgggagaggcgtgccccagagcgtacgaggtcacccacttccgcagctcctcggcgagcacagtgcgtcgcttgacggtcagcagcttggagtcggtgaggccttcgggaggccggcgcagtccggtgatcgccgcgcagacggtgacgggcccggcccacgcgccgcgccccacctcgtcgacaccggcaatgaccttcgctccggtcgttgcgcggagggagcgctcgacggtgtgagtgggtggttcgtacggcatggcgcccttagcgtacgccgccgggaaccccctgcgacaccccggttcccctgggcgacctcagggccttcaccgacggcgccacagataccggtcgagcaccgcacaagcacacgatcagacaccctccagccgcacaccagccgggcccgggactccccatcgggcgccctccggactcgcatccgccatcttccggactccccatcggccacctctcggccgcgacatcggacatctcgcggccgcagcgtcagacaccttccgaccgcagcgtcaggcaccttgcggccgcagcagcggaaccatcagctgatcgaccagctcctcgatgtcgcgttcactccattcgctcgcgcacatctttgtgcggtacatcatcatcgccggaatggcgtcgaagacgtacccgttcgccgcatcggagcgcacctctccccgttcgattccccggttgatgatggcacgcaacagtttgacggtcggctccaccaccccttcgaggatcacccctccgaagcgatcggcctgactcgagtcgcattcgtgaatcaccgagcgcagcgcgagcccagggcgcgagaacatcgcctcgcgcgcctgtcggcacagctggagcaggtcctcgcgcacgcaccccagatcgggcacctcgtcgaagcgtggcagtcctgcctggagcgcgtcgacgacgaggtcctccttggagggccagcggcgatagaccgccgccttgcccgtctgggcgccggcggcgacaccctccatggtgaggccgttccagccgaccgtgctgagctgttcgagcgcggcgtcgaggatcgcgcgttcgagcacagcaccgcgccggcgaagggaggccgtctgagcgggggcggccgtccagcgcgaagtaaccatctgcgtatctccgtcgagcatgaggaagcggtgattccgggggtggggatgcgccacgcggcatcaaggggatacaccacgcggcggtcggcagcttcagtgaacgcttgcgttcactgtcggggactcactaccgttgacgcgacagtgaacgcgggcgttcactaacgcacttgtgggggacccatagtgacaacctctcagttaatccatgatcagaagaagccgggagcagcccgccgggaggggcaccccggcatcgcactcgccgtcatcgcggcctgccaactcatggtggtactcgattcgacgattgtgaacatcgcccttccgcacattcaagacgcgctcaagttcagcacgaccgacctgacctgggtggtcagcgcgtacaccctcaccttcggcggcctgctgctgctcggcggccgggccggtgacatcctcgggcggcgccgggtcttcatgaccggcatcctgttgttcacgctcgcctcgttcctcggcggtctcgcgcaggaaccctggcaactgctggccgcacgcgcccttcagggcgtcggtggcgcgatcgcgtcgccgacctcgctggccctcatcaccaccacgttccccgagggcccggagcggaaccgcgcgttcggtgtcttcgccgccgtctcggccggaggcggcgcgatcggcctgctcgccggcggaatgctcacggagtggctcgactggcgctgggtgctcttcgtcaacgtgcccatcggggttctgatcgccgtgctcgcgccgatgtacatcagcgagtccgaacggcaccccgggcgcttcgacatcgcgggcgcgctcacttcgacggccggcatggcgtccctggtgtacggcttcatccgtgcgtcggaggagggctggcgggacagcctgacgatcgggtccttcggtgccgccgtggtgctgctgctggccttcggcttcgtcgagatgcgggccaaggagccgatcaccccgctgaagatgttcgccgaccgcaaccgttcgggcacgtatgtgatcatgctgagcctggccgcggcgatgttcggcatgttcttcttcatcgtgctgttcgtgcagaacgtgctggactactcgccgatccaggcgggcctggccttcctgcccgtgacggcggcgatcgtgaccggcgcgggtctgtcacagcggttcctgccggtgctcggccccaagccgttcatggtcaccggttcgtcgatcgtcgtgctcgggctcggctggcagaccttcatcaaccccgacagctcgtacctcggcggggtgctcggcccgatgctgctgttcggcttcggcatgggcctgaacttcgtgacgctcacgctcaccgcggtctcgggtgtcgccgtgcacgaggcgggggcggcctccggtctgctcaacgccacccaacaggtgggcggttcgctcggcctctccatcctgaccacggtcttcggctcggccagtcgtgacgaggcggagaaacagttgccgaagttcctggcggacggctcggccgagcagaaggcggagttcgccaagacgcatcagctgcccgctccctgggggaacgaagtgctggcgcacggcatctccacggcgttcatcccggccgtcgcgatggccgtactggccctggtcacggccggattggtcatccgggtccgcaagagcgacctggaggccctcgccggtacggcgggcgcggcgggacccgccggaggctgaccggccgtggttctgtgccgctgatcggccgatcagcggcacagaaccacggaggccgggccacgtggagctgagcgggggccgtccgaagcgatgggcaagggctgcctgatcctcaccgccgccggcctcggcgcccctctcgccgtactcaccgctcgggagccggcaggtgcctcggcaaccgctcggaggcggtcggcgccgatgaccgtgagagcgcgcgtcagcggtacatcaggtccgtatcgaagcggtcgcacacgctccagtccgcgtccggcgagaccggacggtcgtcgaggatctgccgggcgcgcgcctgcccccagctcgtcgcgtaccaggggccgtcctcacccagaccccgtgcgatggcgcgcagcgcgcaggaacgcagcggctccttcagctcatcgagggccggtacggcgtcggcggacaggtcgcgcgcgtagtcgaggtcgaacttgccggtctcctcgtacctttggacgttgcgctcggcgatcagaccgtccggtgagacgaacccgaacacgagcacccccgcggccgcactcgccgcgacggcacgcggcagccagcgggctccccacaccccggccgccatgatgagcacgatgaccaggccgagccacagctcggccgaaagcaccgagatcctcagtcgcgtgagcccatacgcctccacatacatgtccatacgccgcacagcggatgccacgacaacgagcgcgagcgcgcacagagttcccagcacaccacgtacgagcgtccggtcgcgcgatccgtcgcgcggcgcccagcgcagggccacgacgatgacgagcagcgtcagcagcgtgaccaggagcagctgccagaagccctggcgcgcgtactcggcgtacgtctggcccgtcttcttcagtacggcgtcgtacccgccgaagagcacggcgagttgtaccgcgttgaagaccgcgaagagcacggcgagcacgatcagcggcagtgcccactcgacgcggccgcgctcacggccctcgggtatctcggcccggtcccagcgtgcgggagcggcggctgtgtgcgctgccgcgagcgcccagacgacgcccaggacgaacagcaggacatgccaggggccgccggagacggaggcgtccggcacgaggtcgccgagcaggtcggcgaaggcggcgtccgcgccggcgaacagagccccgaagaccaccagcagcaccgcggccactacgagcgcacgcagtaccggtcccacgcgcccgtgcccgccgcccgcacgctcgcgcagtccgcgccagccccagacggcgccggtgaacacggagttgaacaccccgatcggcccgagcagcacagcgggccacgtgcgacccccgtgcagcgcgagcgagccgagcgcgaccgcggtgacgacggccaggaaggacggccagtccgcgtcgcgcagggcgggaaccgccagcagcgcgaggccgcccactccccagacgagcgtccacgcgcgcgtgcgtcggcccgccgcctgagcggcgaagtgcgcggcgagggcggccgggatcgcgacgaacaggaggttgaccgccagtccgtcgccgaggaacaacatgctcaggacgccggtggcgaacgcggcccagagggtggccgtacgcaccggagcgggcggccccgcctgaacgtcggcgagccagggcgcgggcgatggcgacggcgacggcggcgcccaatcgtcgtcctggtccggttcggcggaatcgtcgtcggccgaggagccgccctcgtcgccggtgcgctcgaccgtcgcgacacctccggaaacggagcccgagctcttgtcggcgccagcggcggcatctcggctcgcacccgccccggaagtcgcttccgcgcggtcgcgcttctcacggccctcggagcgctctgagcgatcggagtgctcagactgctcggagcggctggcacgcccggcaccgcgggatgcttcggaaccttccggctgcgcatcccttggctcgggcgtggacggtctgtcggacacgggaccccctcccagccggcctcaccgcagccccaagaagaccgcgggcgcggcagagggctggtgaccggtatctcgtcggcacccgcccgtcatgatcatcaggcggcgtggcggaaagggtatccagacgcaccgcggcccagaccgcggcgatcactctgtggcaaggctgtgacagtggcacccgccctgcgccacgcccggcccccggccctcagacccggcccagtgcccgaacccagggaactcgccccaccaccaccaccagcaccagcaccagcaccagcaccagcaccagcaccagcaccagcaccagcaccaggggatatggccctacgccacccccggcacccagtccggcagcttctccgtacgttccacccactcccccggcggcgcccccgccttccccgcggcgaccacccctccgacgatggcgcaggtcgtgtccacgtcaccgcccacccgggcggtcgtccagaaggcctgttcgtagtcgctcagcgcccgcgcggccgaccagagcgcgaacggcacggtgtcgtgcgccgtcgtgcgccgcccacagcccagtacggccgcgacggtcgccgcgtcgccgtagtcgagcatgtcccgagcccgccgcagtcccgcgccgacggcgctcttcggcacgagcgcgatcactccgtcgagcagcgcctcggcgctgggcggacccgtcggatcggcggccagggcggcggccgcggcgacggccatggtgcccaccacggcttcacggtgctgatgcgtggggtaggccgagatctccgcctggtgggtggcctgctccgggtcgtccgcgtaccaggctcccagcggcgcgatacgggccgccgcgccactgccccacgatccgagccccttgaagagggcggaggcgagctcccgccagtcgccaccctcgccgacctgacgcagcagccgggcgaccgcgggcccgtagccccggtcgggatcgaggtgctcggcgaaggagcgggccagcgcgtcctggtcgatgcggtggtgcgcggccagaactgccaccacggagcaggtcatctcggtgtcgtccgtccaccgccagggacccggcggcagctcgcggcgcttgagcagggggtagtgcgcgggcacgaagaactgcgagccgagcgcgtcccccaccgcaagtccgcgcaggcctgacagggcgcgctccaggcgcccgtcgtatgaggagtcagcggtcatcgccttgccactctatccggtggctccgtaccgttccggatcacgccagcgttcgaacggccggtcaagtgagtacttgccgtcgttcccgagaacgagcatccgcatctccgcgttccccgggttcgacagcgattcgaactccgcgaccgaccaatggaaccagcgcatgcagaacagccgcatggccaggccgtgggtcacgatgagcacgttcggtggatggtcgggcgcctcgaagctccggaacagactctccaggaaaccgccgacccggtcgtacacgtcggcgccggactcgccctgcgcgaagcggtagaagaaatgtccgtacgcgtcccggtacgccttctgcaggcgtacgtcgtcgcggtcctgccagttgccccagtcctgctcgcgcaggcggggctcctcgcggacgcggacgaggtcggggtccaggtggaacgcgcggagcgtttcgagcgtacgccggtacggggatacgtaaacgcttacgccctcctgcccgaagagctcgcgcagctgtttgcctctctcctccgcctgccgccatcccacctcggtgagcggcagtgcgtgatcgggctcgcgttcgtagacggtgtcatcggcattgcccgctgactcgccgtgccggacaaggacgatgcgccgtggtcgtgccatgccaaaaccctagatcgggcggcgccggatcgagcacccacatgggctccatacggcgtaggtcacacgtacatgcccgtttgaatgcgattcatcccctttgaagagcgccgttcgcaccccggacaggccatccgttcgcgccctccgaagaggccatcgtccaccccttcgaagagggaccgtccagatatcaaactatccaggccggttccagatcgacgatgtcgcccgccagggccgcgacgtcggcctccgtctgggccctgagcgcgagtcgctccacccgctcggcgcggtacttcccgtgctcggcggccgactgccacatcgacaggatcaggaactcgtgccccggcgcctccccgaacagcccgcgggtcatcccgggcgagcccgccatcgcggggttccagaccttctcctgcatgagtgcgaagtgctcggcccgctcctcgtggacccggcaatgcgcgacacgcaccaggtcggcgtcggtgaagcggggctcgaaaccggtcttcacatcgaaacggtgatcgaagagtttgacttgtgaatccttgaaggtgcccgactgcgtggcggcgagacgatcatgggagcgcgccatgaaggagtcgtagaaggcacggctttcccagaaggcgaagatgtgcgcgacaccgggccgtcctcggctccagcctccgccctgcccccggaaacccggctctccgagcagccccgcccaccttcgctgcccccgctcgaaaccgcggcggtccaccacggtgcagcgaatccacttgaccagcaccgcgccatcgtaaggccacggagcgtggcacaggtcacgctccggcggagtgcacccgagcgagcgcccccgcgcgcgtggcacgatggacaactgacctgggctgcacagcagttcgggccgagggagtacagggcgacggggaggggatctctggtgaacggtctcaacaaaggcatccgcaaggtcgagctcgcggtgaaatgggaccccagtccgcccggcgatccggccaccgatctcgacatcgtcgccgcgaccttcctggccggcgacgcgtatgggaaaccggcctacgtagtgcacttcgacagccgctcccccgacggcacgatctacctcaaccgggacagcaaggacggcaagggcttcggctgggacgaggtcatgacgctggagctgaaccggctcgacagccgctacgcgcgcgtggtggtcggcgtcgtgatccagcagcgcgacgcgcaccggacgttcgtcggcgtcctgaaccccggcctgcgtatgcgcgagggctacaccgtgctggccgaggacgacttcggcggcgtcctggggtcgacggcggcgaccgtcggtgagttcgtacgcgacgactccggtgaatggaccttccacccgggcatccacggctacgactcggacccggcgaccttcgcgcgcgtcatgggcggccgtcaggactcctgaccgcggccccgcgagcgatccggcccgcgaagcacccgccaacgccgaagggcggcacggcccaaggccgtgccgcccttcggggcttcaggtcagctgcaaccgctggtcgagccgcaaccctcgcagatgtagcaggagccggcccgctgcatcttggtaccgcaggagaagcacagcggggcgtccgcctggatgcccagctgcatctccaccagctcggcgctggtgtgggcctgcttcggggcgggcaccgccgccgcgacctcggccttgggggtggcgacggccttcagctcctgcgcacggggcgcggactgggccaggccctcgacgtccatgtcgacatcgtcggacggctcgtaggaacccgtctccaggtgacgctggcgctcctcggcggagtggatgccgagcgcggaccgcgtctcgaagggcaggaagtcgagcgccagacgacggaagatgtagtcgacgatcgactgcgccatccggacgtccgggtcgtccgtcataccggccggctcgaagcgcatgttcgtgaacttcgagacgtacgtctccagcggcacgccgtactgcagacccaccgagacggcgatcgagaaggcgtccatcatgcccgcgagggtggagccctgcttcgacatcttcaggaagacctcgccgagaccgtcgtccgggtaggagttggcggtcatgtagccctcggcgccaccgaccgtgaaggacgtcgtgatcccgggacggcccttgggcaggcgcttgcggaccgggcggtactcgacgaccttctcgacggcctcacggatcgtcgcctcggtcttcgcggtcacctcggccttctcggtctccttcttcttcgcggagagcggttggccgaccttgcagttgtcgcggtagatcgcgagcgccttgacgcccatcttccaggcctcgaagtagacctcttcgacgtcctcgacggtcgccgtctccggcaggttgaccgtcttggagagcgcgccggagatccagggctgaatcgcggccatcatgcggacgtggcccatcgcggagatggagcgctcgcccatggcgcagtcgaagacctcgtagtgctcgtgcttgagacccggggcgtcgatcacattgccgttctcggcgatgtgggcgacgatcgcctcgatctgctcctcctggtagcccaggcggcgcagggcctgcgggacggtgccgttgacgatctgcatcgaaccgccgccgaccagcttcttgaacttgaccagcgcgaggtcgggctcaagaccggtggtgtcgcaggacatcgcgagaccgatggttccggtgggcgcgatgaccgaggcctgcgcgttgcggaagccgttcttctcgccgaggtgcagcacgtcctgccaggcctccgtggcggcggcccagatcggcgtgtccaggtcgtccacgcggacggccacgccgttggcgtcggagtgctgcttcatgacgcgctggtgcggctgcgcgttacgggcgtatccgtcgtacgggccgacgaccgcggcgagctcggcggagcgcttgtacgaggtgccggtcatcagcgaggtgatggcaccggcgagggcgcggccgccgtcggagtcgtacgcgtggccggtcgccatcagcagggcgcccaggttggcgtaaccgatgcccagctgacggaaggcgcgggtgttctcgccgatcttctgggtcgggaagtccgcgaagcagatggagatgtccatcgcggtgatgaccagctcgacgaccttggcgaagcgctcgacctcgaaggactggcggcccttgccgtcgtccttcaggaacttcatcaggttcagcgaggcgaggttgcaggacgtgttgtccaggtgcatgtactcgctgcacgggttcgagccgttgatacggccggactccgggcacgtgtgccagtggttgatcgtgtcgtcgtactggatgcccgggtcggcgcaggcccaggcggcctcggccatcttgcggaagagcgacttggcgtcgacctcctcgatgacctcgccggtcatgcgggacgtcagaccgaacttgccgccctcctcgaccgccttcatgaacgtgtcgttcacgcggaccgagttgttggcgttctggtactggacggacgtgatgtcgtcgccgcccaggtccatgtcgaagcccgcgtcacgcagggcgcggatcttctcctcctccttgaccttggtctcgatgaagtcctcgatgtcggggtggtcgacgtcgaggatgaccatcttggccgcgcggcgcgtggcgccgcccgacttgatcgttcctgcggaggcgtcggcaccgcgcatgaaggagacgggacccgaggcgttgccacccgaggagaggagctccttggaggagcggatacgggagaggttcaggccggcgccggagccgcccttgaagatcatgccctcttccttgtaccagtcgaggatcgactccatggagtcgtcgaccgccaggatgaagcaggcggagacctgctggggctgcggagtcccgacgttgaaccagacggggctgttgaagctgaagatctggtgcaggagggcgtacgccagctcgtgctcgaagatctcggcgtcggcgggcgaggcgaagtacttgtagtcctcgccggccttccggtacgtcttcacgatgcggtcgatgagctgcctgaggctcacttcgcgctgcggggtgccgacggcaccgcggaagtacttgctggtgacgatgttgaccgcgttcaccgaccagaagtcggggaactcgacgccacgctgctcgaagttgaccgagccgtcgcgccagttggtcatgacgacgtcacggcgcgcccactcgacctcgtcgtacgggtgcacgcccggagtcgtgtggatgcgctcgatgcgcagccccttggccttggtgcccttggcgcgggaacctcgtgccggaccgctcgccgtctctgtcatgccgcctccctgtaccgggctaaaacgccctgaagtgcctcgttcttcccgtggcacggtgtgtgtctgcttgtcgcgcacgccgttcgcggctgcgcgcaacgggtctgtggtcgcctccgatcagaccggcccggccggcctgcccgtcagtcggcgacggtggcgggaacggggacttcgacagtccctccggacccgcggtcggttccctggcgctcggcgccagcgtcttcgtggtcctcgtcgtccacggcggggcgctcccgctgctcttccctgagttccgcgatcgcggcctcgaagtcctccagcgagtcgaacgcccggtagacggacgcgaaccgcagataggcgacgaggtcgagctcccgcaaggggccgagtatggccagccccacgtcatgggtggtcagctcggcgcttccggtggcgcgcaccgcctcctcgacccgctggccgagctgggcgagtgcgtcctcggtgacaggccgcccctgacatgccttgcgcacgccgttgatgaccttggtgcggctgaagggctcggtgactccggaccgcttcaccaccatcagcgagcacgtctccacggtcgtgaaacgacgggagcagtcggggcactggcggcgcctgcggatcgacgtgccgtcatcggtcgtacgactgtcgacgacgcggctgtccgggtgcctgcagaaggggcagtgcatggctccaaccctccttcacagcacgactcatagacctcgtgaggcctcacgggcccctcgaagcagccccaagcataggcgatggccggaccttcggaagaccgggggaccacaacttgtgggctgccgccgcaatgcaaccactagatgtggggcctgactcgtaaatccacccacgacgcgcgtgtcgtgcgcgtatgggcatgtgccgcacggccataccgctccagcaggcacggagatacggtgggcggtgtggggaaagggggtcggttcccccttgacagggtgcgcgatggcagactgggcgccgacccgcgtcggcccacaaggccctcacttcggcgctgaagagtacagcaataggcacttttgtccgccggatgcgacatcagccatacacgcagacgcttgatcacgtcaggcaatccgcgttttttcactcgaacgtgtgtttggcgcaacctttcgaaagcaactaccgttgtccagcagggagaccatcgagaggggccgacgtgaccaccaccgcagacagtgccaccatcactgcccaggaccgctcccagggccgactcgagccggtgcatgcgatgaacgaagccacaagccacgagggacccaagcgctccctgccaggccgacctccaggcattcgcgccgacagctcgggactgaccgaccggcagcgccgggtgatcgaggtcatcagggactcggtgcagcggcgcggctacccgccgtcgatgcgggagatcggccaggcggtcgggctctccagcacctcttcggtcgcacaccagctcatggcactggaacgcaagggcttcctgcgccgcgacccgcaccgcccgcgcgcatacgaggtgcgtggatcggaccagtcgtcctccgtgcagcccacggacacggcgggcaagccggccgcgtcgtacgtgcccctcgtcggccgcatcgccgccggtgggcccatcctcgccgaggagtcggtcgaggatgtcttcccgctcccgaggcagctggtcggcgacggtgagctgttcgtcctgaaggtcgtcggcgactccatgatcgaggccgccatctgcgacggggactgggtgacggtccgccgccagcccgtcgccgagaacggcgacatcgtggccgcgatgctggacggcgaggccacggtgaagcgcttcaagcgcgaggacggccatgtgtggctgctcccgcacaactccgcgtaccagccgatccccggtgacgaggcgacgatcctcggcaaggtggtggcggtgctgcggcgggtgtgacccccgcagtcggcggcacaccacgcccctgaccgggccccgggaccacctgcgccggttccggggccctgtgccgtccggaccccggtccaggagtccgcggcgccgcgatcagcctgtcccgcggccgaggccgttgggggcaggctgatcgtcttccggctaggcgccttccgactccttggccgcctcttccgttacttccgccacttctgtcacttccgtcacttccgtcttcttcgccgcctcgtcgatcgcggtcagtgatctgcggacctggttacggtcggtggtgtaccagaagtcgggcagtgacgccttcagatagctcccgtagcgagccgtcgcgagccgctggtccagtacggcgacgacgccgcggtcccccgaggcccgcaccaggcggcccgcgccctgggccatgagcagggccgcgtgtgtggcggcgacggccatgaagccgttgcccccggcgtcctccacggccttctggcgggcgctcatcagcgggtcgtcggggcgcgggaaggggatcttgtccatgacgaccagctggcagctgggccccgggacgtcgactccctgccagagcgagagcgtgccgaagaggcacgtctcggggtcggccgcgaagttcttgatcagctcgccgagcgtctcctcaccctggagaaggatcgggaactcggggatccgggagcgcagctcctccgcggcgagctgggccgcccgcatcgaggagaacagacccagcgtgcggccaccggctgcctggatcagctccgtgagctcgtccagcatgtccgcccggtcgccgtcgcgcgcggggcgcgacagatgcttggcgacgtacaggatcccctgcttcgggtagtcgaagggggagccgacgtcgacgcccttccactgcggaaggtcgtcgccctgcgtgccctcgggggcgagtcccagagatgcccccaccccgttgaagtcgccgcccagcttcagcgtcgcggacgtcaggacgaccgaacggtccgcgaaaagcttctccctcaggagcccggacaccgacatgggggcgacccgcagggacgcgccgaagcggtcgtggcgctcgtaccagacgacgtcccactcggagccgttggtgatccgctccgcgacgtcgtgcacgctctccaccgaagccagcgcctgcttgcgcaccgcgtcctcgtcctgcacggacttgtcgcgggtggcgccgatcgccgagatcaccgtacgggcggcgtcgcgcagtgccatcagggcgtacccgaggtcctcggggatctcctccaggcgtccgggcagggccagctccatcagccgctcgaagccctcggcggcggtctggagctggtcggcggccttctcgttgacgagcttggcggcgcgccgcaccgcgcggttgacctggccgggtgtgagctcgccggtcgcgacaccggtcacgcgggagaccagctcgtgggcctcgtcgacgatcagcacctcgtgctgcgggaggaccggcgcgccctcgatggcgtcgatcgcgagcagcgcgtggttggtgaccacgacctcggcgagcttggcgcgctcgcgggacatctcggcgaagcactcggcgccgtacgcgcacttcgtcgcgcccagacactcccgggaggacacggacacctgggcccaggcgcggtcggacacccctggcgtcaggtcgtcgcggtcgccggtctcggtctcgtccgaccagtcgcgcagccgcagcaggtcctgccccagcttgctggtgggcgcggccgcctcgaactggtcgaagagaccctcctcctcgtcctgcggcacgccctcgtggagtcggtgcagacacaggtagttcgaccggcccttgagcatggcgaactccgggcggcggcgcagcagcggatgcagcgcgtcgacggtgcggggcaggtcccgctccacgagctgccgctggagcgccagggtggcggtcgccacgatgacgcgctccccgtgcgcgagcgccggcaccaggtagccgagcgactttccggtgccggtgccggcctggaccagcagatgggagctgtcgtcgatcgcctccgcgacagcttcggccatggtcacctggccagggcgctccgtgccgcctacggcagtgacggcagcatgcaggagttcggggagtgagggctttgtcatagcgcgaccaccctacggggcggcactgacaaccgggtgcccaaggccggagcgcgggacgcgatcaagggccgtgaagggggtgggaggcggtactgcgcacggccgcgtacgggcctcggagcggtcgcgccggcgatcaaggaagcgatcacggcggcgggcggattcggcacggggctcctcggctcggaaccggaacagggcgcgcggtgtactgagacggatcgcgctacaggagatcgcgcaggggccggtcccggaccatgagggccgctcgtttgtcgggcaggtcgacctcggcggagaaccggaagcccgcgcccaggaaggcggacacggaggaggtgttgcgcagatcgggttcagcgaccacacgtgcgcaggaaggacgccggtcgagtacgaggtcggcgacggctcgcagcagtgtggacccgaggccgcgcccgcggtcggcgacaccgccgatgaggaggtgaattccggtgtcgtgggggcgggccggatagtgacgggccaaggagtcgaggtccgcgcggtagatctcccagtagctcatcggtgtgccctccagtacgccgaggcaggggacgctgcgcccgtcaccgcccaactgggcgcgcagatgctgctcggtcaccgactcgtcgcccgccagcttccagaaggcggcgacagcggggtcgttcatccagcgcccgaggagcggaaggtcgcgttccgggcggacgggggcgagctggaaggtgcccgcgggggtgacggtggggccccagtcctcgacgcggccgagcaggtcgtcagcggcccgggtgacggagacggcttgcctgccggcgagggccttggtgtcgccgagggaaggcggggcgggtgcgggtgcggtggcgaacgtgaccgacggggcagacgtgaccgacggggcggaggggaccctagaggcggaggggaccgtagaggcggcagcgaacggggccgccggatcaacggcgtcggagcaaccgtccgaatccgccgaagcagccgtggcgccggcgcgggccgggacggagggagcggccgtcgccgtgccctgcgcctcgggccccgcgtccttacgccccgctggctcttccgcgcctcctaccgcatcttcctcgccgcccgctgtcccttcctcgcctcgtactgcaccatccccgccgcccgcagcctcttcgccgcccgccgcctcttccgcggcgaagagcgcgacgagttcgtcgggcagccgcagttccagcgtgtcctcgctgtcggcggctgagcgggctgagacggcgatacgggcggggtccgcagaggtagcgggctcggcgtcggtgctcgcatcggtgggaggcacggcgacgctcctctcagaagacggggtgggtcatgttcctcaggaatgaaggggattggcgatggtgacgtagacggactgggtgtcgaccgggccgacgagctcgtcgaggccgtgcaaccgggtcagcaggttggccttgcagcgcagcacgggtgagtcgagcaggcgggtcggcagcggtgtgcgcagccgggcggggccggtggcgacatcggcgaggaagcgtcggaaggccgccagcagcagttgctcttcggcaaggtgctgggagccgaacgccccgatgagcccgagcacgttgttgatgccgaggtagtacgcgaagcgttcgtcggtgacctcgtcggagacgaaggtgtcactgtgctcgccgatgccgggcagccgggcctcgagttccgcgcgccgggacgtacggaagtagtacccctggttgtcccggtagcggccgcccgtgggccagccttcggggtccagcaggagcagggtgttctgctggtgggcctccagtgcgatgcccgcctcgctgtcgagccacagcacgggccgtacgacctgctccagataccgcaggaaccactcggtggccacggcaccgcggggacggcccgtgcggccggcgagccggatgatgatctcggcgagccgcgagcgcatgacgggacggggctgttcggtgggctggggccaggggcgtggcgagacgagcccggcgacgcaggagacgtcgtcggtcggggcgaacgggttgtggcggatcatcacgtcgagcccggggaccgcgttcccgtgctggtcgtcgacggcgagccaggccgggtcgcggacgatgtcgaagccggggtgcgctgcctgccactgctcgccgaggccgctgcgcagcagacggtggacctcgacgccccggtgcagttccttgcggaggttctcccggcgggagttggtgatgcgcaggcccagcgacagcttcagcatggccggggcgccggtgcggtggacggtgcggacggatgaggtggggtgccacgcggggccatgggggccgagatcccggatcagtccggcgtcgagcagcgcggcggcctcgggacggtgccggatctcgcggatctgccaggggtgcagcggcagcgcggcgaacccgtcgggcatcggcagtccgtcgccggcgagccgtgcggtcagctgctcggcgggcacgggacgaccgcgctcggtccacgccgagttcgtggcgagtaccgggggcgcgacggccagccagtgcagggcgaaggatccgcgcagctcgggtgagtagaggcgggcttcggcctcggagaggccctcgcggctcttcggcgtggggtgcagcgggtgtccgagcagcagcgcctgttcggcggcgaggaagaggtcgggctcgtcggcggggcgggcgcggcggtcgtcgatgaagacggcggtgcgacggacggagtcggcgacacggcccaccaggtcggcgctgtggtcgacggcgcagtggtcgacggcgctgtgcgcggggcggggggcgcggcggcttccggccgcttccctggccagcagcgccaccaccgtcaccgcgtcggccggcggggccgtctgcggcgcgtccgcgaggtacgggaggccgaagcggtgccagcccgtcggggaccagtggtgaacggggacgaggagggcggtgcccgtggcgagcagggggatgcgcagggtgccgtcgtcgggggcgacgaggccgttctcccgtacccagcagcgcagcaggttctcgacggcggcggcctgggcggcggtctgggcttcgggatgatccagcgggtcggcggtggtgccgcgcagccgctcactctcccgagcccgtccaaccggcggggggaccgattcggacgcctgcacaactggggtgcggacctccggtacgaatacgacctgggtcgctggtgcgagcggggcctgggtctcaggtgccggcgcggcctgagcctccgatgcgaacacggcctgggggccctgaacggtcgggagctgggtgtcgtggcctgctcgctcgtgagtgcgggagccgccgtcggatgtgggggtggcgttcaacagagttcctcgtggggcgttatggggcgttgtggggcgttcgggctcgcacggggcgagccggggacacgggtgatggggggggcgctgcgggccgtccgggtcgatgcggctggggcgggggagccatccaccgatcccgcctcacgctccggccgtacgcgactacccggcccgctccgagcgctggaagcctcggctccgttctgcccgcccgcgcgccaccgcttccaccgcgtccgcgagtcggtccagcaccgcggtcgcctgttcgtcgctgatggtcagcgggggaagcagccggaccacgctcgcgtgccggccgcccagttcgacgatcaggccacgccgcagacactcccgctggaccgcggccgccagttcgggcgcggcgggacgcgggcccgcgccggccgtgtccagggacgcgaagtccccggaacccggactcaccgcctcgcgatcctcctcggcccgcaccagctcgacgccgatcatcaatccccgaccgcgcacttccccgacacacgggaactccgtcgcgagtgagcggagttggtcgagcatgcgcgcccccagggtctgcgcgcgttcggcgaggcggtgctcgcggacgtacgcgagcgtggccgtgcccgcggccatggcgagctggttgccgcggaacgtgcccgcgtgggcgcccggttgccagacgtcgaggtcgtcccggtacacgacgacagcgaggggcagactgccgccgattgccttcgacaggaccatcacgtccggtacgacaccgctgtgttcgaccgcccagaaccttccggtacggcccactcccgtctgcacctcgtccgcgatcagcggaatggaccggtccgcggtgatcgcgcgcatccggcgcagccaggcatccggcgcgggaatcaccccgccctcgccctgcacgggttcgaggatcatcccggcgggcagcggcacgcccgacttgacgtcgtcgagcagcgactcggtccaacgggcgccgagttcggcgccacgttcgccgccgatgccgaagggacagcggtagtcctgtggatagggcaggcgcgccacccgtccgtcggtcgcgcccccggatgcctcgagcgcccccgcggtcatcccgtggtacgcgccggtgaaggcgagcagtccgctgcgcccggtggccgtacgcaccagcttgaacgcggcttcgacggcgtccgtcccggccggcccgcagaactggacgcgcgcccggtcggcgagcccggccggcagcgtgcggaacagctcggtggtgaacgcgtccttgaccggggtggccaggtccaggacgtgcagcggagccccggagtcgaggaccttccggatcgcctccaggaccaccgggtggttgtgtcccagagccagtgtccccgcgcccgagagacagtcgaggtagcggcgcccgtcggccccctcgatggtcagcccgcgcgcccggaccggcacgatcggcagggcgcgcgcataggtgcgtgccgcggattcgcgcgccgactgacgccgcagaatcccctcgtgcgccgcgtgcgctccctcggcttcacgtttcagggacgccaccgcagacttggtcacagccacgacgacagttcctcccgctgttcagaggcgagttgagggagggcactgaacggacgcgctgaacacaggcggcaggccccccgtacgtaccaacgagacggctcgctcggggaagcgggtgagccgaagatccttgccgatggctgcagaccttgccgatggctggcgaccttgccgagacccaagacctcgccgatggctggaggccccgccgatgcccgatggtcctcgcccgtgaccggagaccccatcatgatcgaaggcccttgcccgtgaccgccgttctccgggtgatcatctccgtgacggaaccgttgccgccccgtcggatgtcccccacagcgaccgcatagtgtgtggtgccgtccggcggagacggatgatcatcgggctatcggttctcgcgacagcgatagcggtcgcgtaccgagggggccgaatccgcgcatccgcaccaaaccgcggtacgcgaccgcgtatcgcggtcgcacccgcagtacagatgtctcttcaccagggggagttcacaccatgcgaccgattcgcccgctcttcgccgctcgccgagggaggagcgcacgccgcaggacctctcccgtgctgggcgccgtcggcctcgccacggcactcgcgctgaccgccaccgcctgcgactcgggcgacgacaccaaggcgagcagcgagtcgtccccgtccgcgtcctccgccggcgacgacaagatcaagatcccggacgacatcagggacaagctcaaagagcgcgggatcgacatagacaagtggaagaacggcgcctggaagaactggaacagggacgactggctgcgcgaggccaacgagtacatcaacccgatcatcaagggcctgtgggacccggaccggatgcgtgacgccgacgacccggacaagaacaagggcgtcgacgacaacgacctcaccggcgaccagggcgtcacggacccgactccggcgccggtgaacgcgaaggcggtgcaggcggcgtaccacgacaacgcccccaccgcgggcaaggtcttcttcgacgcgcccgagggcacgatggtctgttcggcgaccgtggtcgaggacccggcgcacccgggcaagtccaacctcgtgtggaccgcgggccactgcgtgcacgccggcaagaagggcggctggtaccgcaacatcgcgttcgcgcccgcgtacaacaacgccggccagacgaccgccgagctgcagaacgccacgaagcaggagatagctccgtacggcgtctggtggggcgactgggcgcagacctcgcagcagtggatcgagaagggcggcgagacgggcggcgacggcgcgtcgtacgactacgccgtcatccatgtgacgccggagaagggcggcgacggcaagtccctggaggagacggtcggttcggcccttccggtggacttcaacgcccccgccgtgccgaaggtgagcagcatcacggcgaccggctacccggccgcggcgccgtacgacgggcagacgctgtaccagtgccaggacaagccgggccggctgtccatcgccaagtcggacccgacgatgtaccgcatcggctgcacgatgaccggcggttcgtccggcggcggctgggtggcgacgggttcggacggcaagcccgcgctcgtgtccaacacctcgatcggcccggtgacttcgggctggctggccggcccacggctcggcccggtggccaagggcgtgtacgactcggtcagcaagaagttcgcgggtcagtagcgcgagggtctgacaggagtcggacggacggacggcggcggggtggtgggtgaaaaccttcaccaccccgccgctgttcgcccccattcgcccgggcatagtggagtgtcgcggccgggcgggttccacggagagccacgccgccgcctgacaagcacatgacagcactgcgttttcaacgggggttacacaagcatgcgttccgtacgtccgcccttcgcgcgccggcgcgggaggaacaccgtcctcgccgcgaccgtcgcggccctggcgctcaccgccaccgcctgcaacggcagcgacgacaaggcgagcgacaagcccgagaccaccacctcgcaggcggccggccaggacaaggcccggatgcccggcgacatcgccgcccggctcaaggagcacggcgtcgatgtcgacaagtggaagaacggcggctggaagaactgggacaaggacaagtggctcagtgaggccaaggacttcgtcaatccggtgatcaaggggctgtggaagcccgagcggatgaagtccgccaaggacccggacaagacgatctcggcgaaggacgcgtccgccgaccagggcgtcagcgacccggatccggcgcccgtcgacgccacggccgagaagaccccgtaccacgagcacgcggccccggtgggcaaggtcttcttcgactcccccgagggctcgatggtctgttcgggcaccgtcatcaaggacgtcaaccacccgggcaagtccaacctcatatggaccgcgggccactgcgtgcacgcgggcggcagcggcggctggtaccgcaacatcgcgttcgtgccggcctacaacgacctcggcaagtccgcggcggcactgagcgacgccacgtcgtccgaggtcgctccgtacggccagtggtgggcggactgggcctcgacctcgcaccagtggatctccggcggcgacgagacgggcggcgcgggcgcgccctacgactacgcggtactgcacgtgaagcccgagtccggctccaagtccctggaggagacggtcggtgccgccctcgacgtggacttctccgcgccctccgcgcaggacgtcagcgcgatgggcgcgtggggctacccggccgcgccgccgtacgacggccagcagatgttcaagtgcctcgacgagcccggccggctctcgctctccccgagtctgccgacgatgtaccgcatcggctgcacgatgaccggcggttcgtccggcggcggctggttccgggtcgtcgacggcgagaccaagctcgtctcgaacacctcgatcggcccgtccgacaacacctggctggcgggtccgcagctgggcaagggcgccaaggcgctgtacgacaccatgagcgagcagtacggcggtcggtgaccgctcccgtacaagcggtaggcccgccccctgtgcgagggggcgggcctaccggctgtgacaggtcaggcgagcggtgccggaacgtacggcgcgagatccgccgccagctcctcgtgcacccgcgccttgagcagcgtgccctccggggtgtgctcctcggagatcacctcgccctcggtgtgggcgcgcgccaccagcttgccgtgcgtgtacggcacgagcgcctcgatctcgaccgacggccgcggcagctcgttgtcgatgagcgcgagcagctcggcgatgccctggccggtgcgggccgagacggcgatggagcgcttctcgttcctcatcagccgctggagcaccagcggatcggccgcgtccgccttgttgatcacgacgatctcgggtacgccggtggcgccgacgtccctgatcacctcgcgcacggcggccagctgctcctccgggaccgggtgcgaaccgtccaccacgtgcaggatcaggtcggagtcaccgacctcctccatggtggagcggaaggcctcgaccaggtggtgcggcaggtgccgtacaaaaccgaccgtgtcggccagcgtgtacagccggccgctcggggtctcggcccggcgcacggtcgggtcgagggtcgcgaacagcgcgttctcgacgagcacgcccgcgcccgtgaggcggttgagcagcgaggacttgccggcgttggtgtaaccggcgatcgcgactgaaggaaccttgttccgacggcgctcctggcgcttgatctcgcggcccgtcttcatgtccgcgatctcccggcgcatcttcgccatcttctcgcggatccgccgacggtccgtctcgatcttggtctcaccggggccacgggtggcgaggccgccgcccttgccgccgcccatctgacgggacagcgactgaccccagccgcggagcctcggcagcatgtactgcatctgcgcgagcgcgacctgcgccttgccctctcgggacttggcgtgctgggcgaagatgtcgaggatcagggccgtacggtcgatgaccttgaccttgacgacgtcttcgaggtggatgagctggccggggctgagctcaccgtcacagatgacggtgtcggcgccggtctccaggacgatgtcccgcagttcgttggccttgccggagccgatgtacgtggccgcgtccggcttgtcgcggcgctggacgacgccgtcgagcacgagcgcacccgcggtttccgcgagggcggccagctcggcgagcgagttctccgagtcctgaatggtccccgaggtccagacaccgacgagcacgacgcgctccaggcggagctgtcggtactcgacctcggtgacgtcctcgagctcggtggagaggccggccacacggcgcagggccgcgcgctcggagcggtcgaactgatcgccgtcccggtctccgtcgatctcctggctccaggcgacgtcctcttccatcagggcatcggcccgaagaccctcggggtaagtgtgcgcgaagctctgcgcgtcctgggaaggggaagaagaggaggtcattggatccttacgtagctggggacaccgatacggcggcggacatgaaccgtcaccactcacaacgcgtgagtgccccgggagattcccgggaaccgtcccgccggggctctgcgcgccccccaggggcccggccgcgccgccgacctgaagatggtcgcacggaacggcccgtctcgtcaccgggtttatttcgtggcctgcccggacttccagtccgggtgcccgggcatcggcggcgtcttctccccgtacagccacgccttgaagaacctgctcaggtcgcgccccgagagggcggacgccagctgttcgaagtcggcggtcgacgccgtgccgtcctggtggagggccacccaggcccgctccagtcgttcgaagaccggtcggccgatctcctggcgcagcgcgtacagcgcgagtgcggcgccgtcgtagacgttggggcggaagatgctgatcttctggccgggctcggggcccttgggcgctgcgggcggcccgccggtggcccgccaggagtcggatgcctcgtaggcctccttcatgcgcggctccatgggccggtgcgccgtctcctccgcgtacagggcctcgtaccaggtggcgtgtccctcgttgagccacaggtcggaccaggtgcgggggctgacgctgtcgccgaaccactggtgcgacagctcgtgcaccatgatcgactccacgtaccacttcgggttcgtggaccgggtgaacagctctctctcgaagagcgagagtgtctgtgtctcgagttcgaagccggtctgcgcctgggccacgagcagcccgtacgtctcgaacgggtacgggccgaccctgcgctccatccaggcgatctggccgggcgtcttcgccagccacggttccagccgcttgcggtccttcgtgggtacgacgtcacggacgggcagaccgcgcggaccggtccggtggagcaccgaggagcggccgatggacacctgggcgagttcggtggccatggggtgctcggtgcggtacgtccaggtggtcgccctgccctcccggtcggccccggccggccggccgttcgccacggccgtgtacccgtcgggtgccgtcacgtggatggtgaagatcgccttgtcggaggggtggtcgttgcaggggaagacgaggtgggccgcgtcggcctggttggccatcacgaggccgtcctccgtccggacccagccgctgtcctggcccttggcggacacgggatcactggtgtgccgcacggtgatccgcatcggggtcccccgggagaccggcgcctcgggggtgaccaccaggtcctcgcccgcaccggtgaacgacgcgggctcgccgttgacgtcgaccgaccgcacgatgccgtgcgcgaagtccaggttgatgcggtccagccggcccttcgcctgtgcgttgatggtggtgacggcggtgagcggcttgttgttggcgccgggataggtgaaggcgaggtcgtacgaggcgacgtcgtatccggggtttccgaggtgcgggaagagccggtcgccgatccccagggggaccgccggcgcgggggcgctcgcggcgatgaggcagacggagacggcggaggcgagcatcgccgacgtgacgcgacgggttctggggcggggggtgtgcggcatggaccacggctaccagcgcgcgggggcccggcggtgacgactcgcaccggtcccactcgaacgggttcgtggcggccccgggtgagccgggtgccgccgccgggttccgcgggggctctggggttcgtaggggctccgggttccgcgggggctccgtgacagcgccggactgccatcgggcggctccggcgcgcggccgcccggcccggagctactgcgcggccgccgcctggtgctgcgcccggctcacgtcgaacaccccgggcacgttccgcatcgcgcgcatgagggccgggaggtgtgccgcgtcagggagttggagcgtgtacgtgtgccgtacgcgctggcggctcgggggctccacggtcgcggagacgatcgcgacgccctccacggcgatggcctcggtgaggtcggcgagaaggtgggggcgcccgaacgactcggcgacgagcgtgacccggcattcggaggtgtccccccagcgcacaccgacctccgcgcgccccacgctcttcatgcgtgccactccggcgcactcgactcggtggacggtcaccactcccccgcgcacggcgaatccggtgatctcgtcgggcggtacgggcgtacagcagccggccaggcggaccgaggctcccggctggtcgacgacggcgttcgcggcggggcgggcggcgggtccttcgggggcgaagcgggcggcgccctccgcggcggggtcggcggcgaagcgttcggcgaagccgtccgtggcggggccgtcggcgggctcctcgctcggcgacggcgacgggtgcgcggccagccaccgctggatggcgatccgcgcggcaggcgtgtgcgcatgctccagccactccctggagggctcggacgcggggtcctggcccatcaggagctgcacggtgtcgccgtccttcaggaccgtactcagcgtcgccagacggccgttgacacgcgcgccgatgcaggcgtgggcgtcctcgccgtactgcgcgtacgcggcgtccacacaactcgcgccctcggggagacccaacgcgcccccgtcggggcggaacacggtgatctccttgtcctgggcgaggtcttcgcgcagcgtcgaccagaacgtgtcggtgtccggggcggcctcctgccagtccaggagccgggagagccagccggggcgggtcgggtcggcgcgctcgccctcggcggggtcgtcggccccgggggtgtacggattgccgagcgcgatgacaccggcctcggcgaccttgtgcatctggtgggtgcggatgaggacttcggcgacctcgccgtcctcgcgcgccacggcggtgtgcagcgactggtacaggttgaacttggggacggcgatgaagtccttgaactcggagaccaccggcgtcagacatgtgtggagttcaccgaggacgccatagcagtcggcgtcctcgttcaccagcaccaggaggcggccgaagtcggagccgcgcatccggccgcgcttgcgggagacgcggtgcacggagacgaagtgccggggccggatgaggacttcggcctgcagtccggcctcgcgcaggacggtgcgcacgttttcgacgatctccgtgagcgggtcgccgccgttcgccgcgttgccgacgatgagttctctggtgcgctcgtactcctcgggatgcaggatcgcgaagacgaggtcctcgagttcggtcttcagcgcctggacgccgagccgttcggcgagcgggatgagcacgtcccgggtgaccttggcgatgcgttcctgcttctccttgcgcatcacgcccagggtgcgcatgttgtgcagccggtcggcgagtttgatcgacatcacgcgtacgtcgttgccggtggccacgagcatcttgcggaacgtctccggctcggccgcggcgccgtagtcgaccttttccagcttggtgacgccgtcgaccaggtaacagacctcctcgccgaactcggctcgcacctgatcgagcgtcacctccgtgtcctcgacggtgtcgtggagcagagacgccgtcaaggtcgtggtctccgcgccgagttcggcgaggatcagggtcacggcgagggggtgcgtgatgtacggctcgccgctcttgcgcatctggccgcggtgcgaggactcggcgagtacgtacgcgcggcgcaggggttcgaggtcggcgtcggggtggtgggcgcggtgggcctcggccacatgaccgatcgcgtccggcagccggtcgcgggccgcggggccgagcagcgcggcccggcccagacggcgcaggtcgatcctggggcggcccttcctgcggtacgccccgggcgtgacggggccgggcgtggcagggttcgtggcctccgcgctcatgggcacctccggctgcttggaccggtggacggggtgccccatggcgtacgcggcactggggatggcgacattcccccgtccgggccggtgcttgatgctaccgagcccaccacgcgcgtccgaccgcctctcgccgagcgtgaaacggatcacccattcgagcgaaggttcagaggtttacgatttcgagccacgccgaatgcggccgaccgtggattcgaaccggctcgggctgcggaggctgcgcttgacggcttccacagctgccgaaggccgcaatgtcttacggcccggcgcctcagagggccgcgttttccagccactccgcgtcgatctcgccctcggcgacaatcaccgcggggccggtcatctcgatctcgccgtccgggcgctcggtgatcaccagcgttccgcccgggagatcgacggtgtacgtcgccggggtacccgtcaccgcggggtccgcgccgtcgcggcgggcggcggcgacggccacggcgcacgcgcccgtgccgcacgaacgggtctcgcccgagccccgctcgtggacgcgcatcgcgacgtggccgggggcgcggtcgatcacgaactcgacgttcaccccgtccgggtaggcggtcggcggactgaagggcggcggggcgagcaggtcgcccgcgtgcgcgaggtcgtcgacgaaggcgaccgcgtgcgggttgcccatgttcacattgcgcgcgggccagctgcgctcaccgacgctcaccgtgacgtccccttcggggaggaacgccttgcccatgccgacggtgacgtcgccgtccttggcgatgtgcacggtcttcacgccgccgcgcgtggccaccgcgaggtcgccttcggtcacatgtccggcccgctggaggtagcgcgcgaacacccgcactccgttgccgcacatctcggcgaccgagccgtcgccgttgcggtagtccatgaaccactccgcctcggcggccatctccctggcctccggatgggcggcggagcgcacgacgtgcagcacgccgtcgccgccgatgcccgcgcggcggtcgcacagggcggcgacggcggccgggggcaggtcgatggcgttctcggggtccgggacgatcacgaagtcgttctcagtgccgtgacccttgaggaaggcgatccgcgtgctcatccctcgatcgtaaagggtcggtacgacattccggcgagcggtcggacagacggtccgatcggcggccgtggggtgtcggtggtgtcggcccggcaggcggatcggcacagccatgggcaggcggccccgcaggcgtatcggagtagccatgggccgtcgatcccgtagacgcatcgggcagccgtgggcatcaggtcgccccgtcggcgatcggagcagccgggccgtcggtctcgcgggcggatccgatcacgcggcaggcgggtccggcagacgaaccgggttgcccctgagcagtcgctccggtaggtggatcgggccgctcagcgcagccgcgccacgcgccacacggcgagcacgacgaccgcggcgacgacgacggcgtacgcgatcacgacccgccagtccacgcggcggccggagccgcgctgcggcaggcccggccaggtgtagcccacccggcgggcggccatcatgccccagccggcggcgcaggagcagatcagtagtccgagcatggcgaccacggcaccgccgtcgccgaactcgaaggccagcgggaaggcgaacatcagcgagccgaccgcggccagcgccacgatgggcgcgagctgccagatccgcagccggcgctggggacgcagctcgacctcgacctcgggtcccggggacatctcttccggttccggtccgtcggcggtcacgcctcccggcggctgctcatcgggcccgtccgggctcagcaaaactccgtcgggctccagtcggtacccgtcggcgcccagctcgtccccgcgttccggggtgtcctgctccgcgccttgtgcggtatcgcgagggccggcctccatcgccacgcgccctcccaactcggactccacttggtcgatcgaagctcgatgatggcacgccgccggaggcgcggatgacggccggagcgtcccgatgccatgacgtgatcaggctgtaaccggtcgttcgaccaacatcagtgcgagctgcggaagttctgtgagatccgccgcagccccactgagccaatgcacccgggggtcgcgcctgaaccatgaatcctgacggcgcgcgaagcgcttggtggcacgtacggtctcggcgcgcgcttcgtcctcggtgcactccccggcgagcgccgcgagtacctgctggtagccgagcgcacgcgatgccgtacgcccctcacgcaacccctgcgcctccagcgcgcgcacctcgtcgacgaggcccgcctcccacatccggtcgacccggcgtgcgatgcgctcgtcgagttcggggcgcgccacgtcgaccccgatctggacggtgtcgtagacggagtcatggcccggcaggttggctgtgaagggccggccggtgatctcgatcacctcgagggcccggacgatgcggcggccgttgctggagaggatcgcgtggccggcctcggggtcggcggcggccaggcgggcgtgcagcgccccggggccgcgcagcgcgagctcctcctcgagccgggcccgcacctcggggtcggtgccggggaactccaggttgtcgacggccccgcgcacgtacagcccggagccgcccaccaggatcggccagcgaccctcggcgagcagggcgtcgatgcgggcgcgggccaggcgctggtactcggcgacgctggcggcgacggtgacgtcccagatgtccaggagatggtgcgggatgccgccgcgctcctcgggcgtcagcttggcggtgccgatgtccatccctcggtagagctgcatggagtcggcgttgacgacctcgccgtcgagacgctgggcgaggaaaacgcccagatcggactttcctgccgcggtcggtccgacgacggcgatgacgcggggggcggggggtgcgctactcactgccccagtctcgcaaacccgaagaccactcctcgaacgagctacgtgacggcacgggtgcggggtcgttgcctgttgcgaggttccggccgccggtctcgggagccggtgacccgggcgatgcaaacggacgcaccgggctacgcgggatttcgcccgtacgagtaacgtatggagtggatatgggcgtttttgcacgacttctccggaggtcgaaggctacgaaggaggcgtcgaccgccgaggcggaggccgtgaaggtgacggccgtgaaggtgacagctgagcctgtggcgaaggtgacggaggaggcgaagggttccgaggccgatgccaaggcagacaacaaggccggtgccaaggttgcggaaaaggttgaggtcgtagccgagtccgaggtcgagggcgaggcgacgaaggccgaacccgagcccgaggcctcgacggaggacaccgctcagtccgtcggcgagagcgtcgagatccccaagcagcagtccgccgaggaagccgccgacagcgacaccggcgaggacgcccgcacatagatgccccgcgagggaaggtgaaccatgagtctcctggagaatttgaaggccaagctcgccccggccaaggacaaggtgtcggacctcgcgcagcagcacggggacaaggtggaacgtggtctcgacaaggccgcgaagatggtcgacgagaagaccaagggcaaatacagcgacaagatccatacggggacgggcaaggcgaagggtgccatggaccgactcgcgcacaaggacggcggatcgccgggcggtggcgcgactccaccgcatgatgcgcctgggccccccacggctttctgaactgaacagcacatcggcggacggccgcggagcgctcggctcccggccgtccgccgtgtgcgcgcccgcgcggcccgggccggccgcgtcacgcaggcgaccacaccaggcctagcaggcacttcgaccaggccgagcaggcgactacgaccaggccgccaccaggtaccccaccccgtacggcgcgtcgtcatagagcagcgatccgccgagacccgcgccctcggccgcgcccgcgaggacctgccagggggcccggccggaggccttcagctcgtacgccagctccgcgtccagccccttgagggcggtcacgtccgcagcccccagtgcccgcgcgacctccgcgtcgaagcccgccgcgcgctcgtcgagataacccggcgccttgagcgtccggcacgcgctggcatcgcccatcaccagcaacgccgtccgctcgacccgcgcgaccaggccctccccggcctcgatgcaccgctcggccgcgagggtctcccccacaccgaggccttccacggcggcgtcggaccagccggtccgctccagcagccacgccgcgacggccagcgagggcggaagctcaccgtgcgaggccgccggtgccgcccggtccccgcccagtcgtacgtcgaggtccacgccgaacccacggaacgaaccccgcgtgccctccgggtgcggtcctcgcccgctctgctcggcgggcccgaggaccaccagccggtcgggacgcgccgcggcgagtacgcccagcgcgtccgtgcaggcggcacgcgcggcgtccagctcgggcgcggcgcccgtggcgacctcgggcacgaggaggggcggacaggggcagacggcggcggctacaagcatgatcggcagcgtacgcggtcgccgtctgatcgtcgccgggcccgcggcgggccgtccggcccgcccgggtcagtcgcagccgcagccgctgcccgtggcgaccggcagcggctccggtgcgccgatcttcggcagccccagcatcacgcccgccggcttcgccgcctcggctgtcttctcgatgtgtcgcttctcccaggcgtcccccgcgcgcgtgcggcgcacgttcagcacgggaccctcggcgagcaggtggtgcggagcggcgtaggtgacctcgacggtgacgacgtcgccggggcgcacttcctcgtcgggcttggtgaagtgcacgaggcggttgtcgggggcgcggccggacaggcggtgcgtggcgccgtccttgcggccctcgccctcggcgaccatcagctccagggtgcggccgacctgcttcttgttctcgtcccaggagatctcctcctggagggcgacgagacgctcgtagcgcgcctggacgacctccttggggatctggttctccatggtggcggccggggtgccggggcgcttggagtactggaaggtgaaggcctgtgtgaagcgcgcctcgcgcacggcgtgcatcgtctgctcgaagtcctcctcggtctcgccggggaagcccacgatgatgtcggtggtgatggccgcgtgcgggatggcggcgcgcaccttctcgatgatcccgaggtagcggtcctgacggtacgagcggcgcatcgccttcaggacggtgtccgagccggactgcatcggcatgtggagctgcggcatcacgttcggcgtctcggccatggcggcgatgacgtcgtcggtgaagtcgcgggggtgcggggacgtgaagcggacccgctccagcccgtcgatctgaccgcatgcccgcagcagcttgctgaacgcctcgcggtcgccgatgtcggagccgtacgcgttcacgttctgcccgagcagcgtgatctcggagacgccctcgccgaccagcgcctcgatctcggccaggatgtcaccggtcctgcggtccttctccttgccgcggagcgccgggacgatgcagaaggtgcaggtgttgttgcagccgacggagatcgacacccaggccgcgtacgcgctctcgcggcgggtcggcagcgtcgaggggaacgcctccagcgactcggcgatctcgacctgggcctcttcctgtacgcgggcgcgctccaggaggacgggcagcttgccgatgttgtgcgtaccgaagacgacgtccacccagggcgccttcgtcacgatggtgtcgcggtccttctgcgcgagacagccgccgacggcgatctgcatgccggggcgcttcgtcttcatcggggcgagccggcccaggttgccgtacaggcggttgtcggcgttctcgcggacggcgcacgtgttgaagacgacgacgtccgcgtccccgtccgagccgtcgggagcgcgcacgtaaccggcgtcttcgaggagcccggagagccgctcggaatcgtggacgttcatctggcacccgtaggtgcgtacttcgtatgtcttgacgcccactggctggctccggtcgatgctgctcatgccataagggtaggtggtgtccgcaccgcgtcccgccccggagccgcgagaacagcccgcagcacgtggtcgagcagttgccgccctgctcctcgtgatcccccaaggccccgctacaccgccgcgggtccccacccttgacggcggaggatcgccccgacgtccggcgcgcggtagtggtcgcccttgaggaccttgccgtcggcccggcggacggcgcggccgtcggggcccagcttggtcatgttggcgcggtgcacctcggcgatcacctcgtcgaggtcgatcccgtggacgagggccgtgccgtacgccacgtagacgacgtcggccagttcgtgcgcgagccggtcgagcgggccggtgacggacacctcggcgacctccgccgcctcctcggcgagcagctcaccacggtgcgcggccagctccggggagacctcggtcggcacggtgcgggcatccaggccgaaagcgaggtggaacgcgcggaccagggaggcgggagaagcgggagcggcaggagcggcaggagcggcaggagcggcaggagcggcaggagaagcgtgcgagaggggcgcggagtccattcggcgaccctatcgatcgcatcgatcacccacggccgcttcggccgtgctctcgccctccttcgagcccggccctggccagcggagcgtgcgggctggcaggatcgcgcgcatgttccaggcactcccccgtcttcgcaggcgccatgcgctgctcggctcgacggccgctttcgtggtgttcgggctgctgctgtggtggctgctgccgctgggcgaggagtcaccgggcggcacggtcacgttcagtacgggcacgcccaccggcgtctatcagaagtacggcaagcttctgaaacaggcgatcgccaaggacatgccgaagctggatgtcacgctgctggacagcgacgggtcgcaggagaacgtgcggaaggtggcgaccgggaatgccgacttcaccatcgcggcggccgacgcggtggcgacgtacgagctggcgcgcaagccgggagccgaccggctgcgtggctgtgcgcggctgtacgacgactatgtgcacctggtggtgccgcgttcgtcgtccgtgcagtccgtggcggacctgaagggcaggaaggtggccgtagggccgagcggctccggggtgcggctgatcgcggagcatgtactgaaggcggccggtctcgacgcggagaaggacatcacaccgtcgtccgagggcatcgcggccatgccggggctgctcgaacaacacaagatcgacgcgttcttctggtcgggcgggctgaccaccagtgcgatcaccgagctctcgaagggcttcgacatccggctcgtgccgatcggcagcaccctggtcaagaggctccatgagcagggcgactcgtccagctactaccgggcggccgtgatgcccgccgatgcctatcccctggcccagcagggctcgtccgtgcagacgatcgcggtcgccaacctcctgatgacccgggaggacatggacgcgaccctgaccgagcagctgacccgtacggtgatagacagccgtgaccgcatcggctcccaggtgcacgcggcccagctggtggacctgcggacggcgatctacacggatcccctggcgctgcacgagggcgcgagccgctactaccgctcggtgaagccgtagcgaaccggctctccgggccccgtcaggccgtcggcaccgtcctcggcaccgtcaccgtcaccttcagtccgtgcggctcgtggtgcgcgtacgagatcgtcccgccgcccgccgcgagcagtgcccgcgagatggacaggccgaggcccgagcccttgatgttctggtggcccgcgctgcgccagaagcggtcgccgacgcgcgcgagttcctcgtcgccgaggcccgggccgccgtccgtgacgacgaccgacgacaccgcgccgttggacgtcacctcgacctccacgctctctccctcgggcgtgaacttcagcgcgttgtcgatgaccgcgtcgagggcgctggagagagtgatggggtcggcccaggccgtggtggccgggcaggtcccggccagtcgtacgccgttggcggcggcgaccggcccccaggcggcgacgcgctcggccgtcagctcgccgatgtcggtgagccgcaggtccgcctcggcgtgctcggcgagcgccaggtcgagcaggtcgtcgaggacctgggcgaggcgcttgccctcggtctgcaccgaggcgatctcctcgttgccctcgggcagttcgagggcgagcagttcgatgcgcagcagcagcgccgacagcgggttgcgcagttggtgggaggcgtcggcgacgaaggcgcgctgctgctccaggacgtcctcgacgttgtccgccatctcgttgaacgaccgggccaggcgccgcagttccggcggtccgccggcggccgccacccgggacttgaggcgtccggtggcgatgtcgtgggtggtggcgtcgaggacgcgtacggggcgcagcacccagcccgtcaggcgcagtgcggcgccgacggccagcagcatcgcggcgatctcgcccgccccgatgagcagccagccgtgctgggtcttggaacgcatctgcccggtgggcgagtcggtgacgacgacggcgatgacgtcgccgtccctgatgaccggggaggcgacgacgagccgcttgtgctcccagggccagacctgctcggggtcgtggctgcggcggcccagccgggcctcgtcgaacgcgtcgcgcccctcgccccgttcgggcaggtaccagttctggggcgcgtgggccatgggcgcgtcgtccaggtagaagacgccggcctggatgccgtacacgtcgtggtacatggcgagttccttgctcagcgtctcgccgcgttcgtccgtgacggccacccgggagccggtgggccggtcggtgacgaactgcgcgagggccgcgaaccgcgccgtgtcgtctatgcggtcgacgacgacccgctgctgctgcgccgccgcgatgctcacggccagcgggaagccgagcgcgagcagcacggccgccatcaggacgatgagcagcgggaggagacgtgtgcgcacccggccccgctacgcggccggggcgacgagccggtacccgacgccgcgcacggtctcgatcagcgcgggcatgcgcagcttggagcgcagggaggcgacgtgcacctcgagggtgcgcccggtcccctcccagctggtgcgccacacctcgctgatgatctgctcgcggcggaacaccacgccggggcgctgggccagcagcgcgagcaggtcgaactccttgcgggtcagttggaccaccgaaccgtccacgctgacctggcgggtgggcagctcgatgtgcacggagccgaggcgcagcgcggtctcggcggccgccccgccctcctcgtgggcgttgcgccggctgacggcgtggatacgggcgagcagttctccggtgtcgtacggcttgaccacgtagtcgtcggcgccgaggttgaggccgtggatgcgggagcgtacgtcggagcgcgcggtgaccatgatcaccggggtgctggtgcgcttgcgtatcttgccgcagacctcgtagccgtcctggtcgggcaggccgaggtcgagcaggacgacgccgaagccggagctctcggggacgagcgcctgaagggcctcctcgccgttgcgggcgtgcgtgacggcgaagccgtgccgcgccagcaccgcggacagggcggcggcgacatggttgtcgtcctctacgaggagcagtcgcatcccggccccctccggttcatcggtcgtacggtctctgcttgcactctgatagctcgggttctgtacaaaaagcgcgcacacgcgcgtgtgcaccatggcagtgacgccgatgaatcaggacggcgtcaagagggttctggttgcggacggcttccgttatccagccggtacgcaccctgagcacacccctgctacgacacgtgtccgattgctaccggatcgtgatgctcaagttcccctcagatgtaatgacgctggtcgtacggcgttactactgtcctccgaaaccgaggaggacggagccagttagcgatgaccgaagtatcggtggccaaggacgccgtggccgcgaccgacgaactggtcgtcctgaagagcgtcaacaagcacttcggcgcgttgcacgtgctccaggacatcgatctgaccatcacccgtggtgaggtcgtcgtggtcatcgggccctccgggtccgggaagtccaccctgtgccgcaccatcaaccgcctggagacgatcgattcgggcgacatcaggatcgacggcaaggcgctgccccaggaaggcaaggagctcgcccggctgcgcgccgatgtcgggatggtgttccagtccttcaacctcttcgcgcacaagacggtgctcgagaacgtgatgctgggccaggtcaaggtccgcaaggccgaccggaagaaggccgaggagaaggcgcgcggtctgctcgaccgcgtcggcgtgggcacgcagtccgacaagtaccccgcgcagctctccggcggtcagcagcagcgtgtcgccattgcccgcgcactggcgatggaccccaaggtcatgctcttcgacgagccgacctcggcgctggaccccgagatgatcaacgaggtcctcgaggtcatgcagcagctcgcgcgcgacggcatgaccatggtcgtcgtcacccacgagatgggcttcgctcgttcggctgccaaccgagtcgtcttcatggccgacggccggatcgtcgaagaggctgtgccggatcagttcttcagcaatccccgcagcgatcgggccaaggacttcctgtcgaagatccttcaccactgagggcctgctcgaagagccttcaccactgacgatctgcgccacccgccccgctcgtgcggtgcgcgccaccggcggcccaccgccggtctctcttcaccacacaaaggatgttcaccatgaagctccgcaaggtcaccgcagcctcggccgccgtgctcgccctcgccgtcacggccacggcctgcggctccgacgacaaggacagcagctcctccggcggcgacaagaagatcaccatcggcatcaagttcgaccagcccggcatcggccagaagacgccgcagggctactccggcttcgacgtggacgtcgccacgtacatcgccaagcagctcggttacaaggcggaccagatcgagtggaaggagtcgaagagcgccgaccgcgagaccatgctccagcgcggtgacgtcaaattcatcgccgcctcgtactcgatcaccccggagcgccaggagaaggtcgacttcgcgggcccgtacctgctggcccaccaggacgtcctggtccgtgccgacgacaactccatcaagtcgccgtcggacctcaactccaagaagctgtgttcggtgacgggctcgacctcggcgcagaacgtcaaggacaagctcgccccgaaggccaacctcctgaagtacccgacctactcggcgtgcctgaccggtctgcagaacaaggccatcgacgggctgaccaccgacgactcgatcctcgccggttacgccgcgcaggccagcttcaagggcaagttcaagctcgccggcttcaagatgacgaacgagaactacggcatcggcgtcaagaagggcagcgatctcaaggcgaagatcaacaccgccctggagaagatggtctcggacggtgcctgggagaaggccgtgacggccaacttcggcccggcgaactacaagaacgagcccgccccgaagatcggcgacatcaagaagtgacgtagggccccaggggtgcgccgtcctcgggggacggcgcaccccctcgcaaggtccctccacacacgcggaagcgcgggagatcgtgttcgactttcttgaaggttacgacctgctgggagcgttctgggtgacggtgaagctcaccgtcttcgcaggcgtcggctccctgatctggggcactctgctggccgcgatgcgggtcggtccggtgccgctgatgcgcggtttcgggaccgcctacgtgaacatcgtgcggaacatcccgctgaccgtgatcattctgttcacctcgctgggcctgagccagacgctgggtgtcaatctcggcgcggacacgttcgagaccatcaacttccggctctccgtgctcggtctgatcgcctacacctccgcgttcgtgtgcgaggcgctgcggtccggcatcaacacggtgcccgtcggccaggccgaggcggcgcgggccatcggtctgaacttcacccaggtcctcactctgatcgtgctgccccaggcgttccgttcggtcgtcggcccgctgacgaacgtactgatcgcactgacgaagaacaccacggtggcggccgcgatcggtgtcgcggaagcggcggcgctgatgaaggagatgatcgagaacgaggctcaactcattctgatctccgcggtcttcgcgttcggcttcgtgtgcctgacgctgccgaccggtctgatcctcggctgggtgagcaagaaggtggcggtgaagcgatgagctcggtcctgtacgacgcccagggcccgcgggccaagcggcgaaacgttctcttcaccgtggtgttcctggtcgcggccgccgccgtcctgtggtgggtgatcaccagtctcaacgacaaggaccagctggcctgggagaagtggaagcccttcttctcgagcaccgaggcctggaccacgtacctctggccggggctgcagaacacgctcaaggccgcggccctctccatggtcatcgcgatgccgctcggcgcggtcctcggtatagcccggctctcggaccacaggtgggtacgtgttccggtctcgatcgtggtggagttcttccgggccatcccggtgctgatcctcatgatcttcggcgtcgccctgtattccgagtacacgaacgtcagctcggacgaccgtccgctgtacgcggtcgtcaccggactcgtgctctacaacgcctcggtgctcgcggagatcgtccgggccggcatcctgtcgctgcccaagggccagtccgaggccgcgatggcgatcggcctgcgcaagaaccaggtcatgcggttcattctgctgccgcaggccgtcacggtgatgcttccggcgatcgtcagccagctcgtcgtgatcgtgaaggacacggcgctcggcggcgcggtcctcaccttctccgagctgctcgcctcggtcggcccgatgagcggctactacggcgcgaacaccatcgccagcttcacgatcgtggccctgatctacatcgcgatcaacttctccctcacgaccttcgcgagctggctggaggggcggctgcggcgcggcaagaagtcgacgggcgccgtgctcccgccggccgcggtcggcggggccgaatcgaccggcgcgggcggggccggcgggggcatcggcctctgaccggtggcccagggaagccgcctgacaactggtcaggcatttgacccacacggaggcaggtggcgcgctcgccactgcctccgtcgcttgacgcaagcaccggcaataggttgcatacgttctgtgatcgcgcaccccgttccaactgcctgtttccctaggtccctcaggacaccactccgggcagggggcagcgcgccgtggacccggtgatcatcgtcggagcggggcccgtggggctggcgctcgcccttgcgctggcgcgccaggaggttccgtccgtggtcctcgacgagggtccgggcaacgacgaacagcggcccgcgcgaaccgtcgttctgcgcgaggacaccgccgcgctcatggaacggctgacgggtctcccgctcgacgaggccgggttccgttgggccggatggcggtcgatgcggcgcaagcaggtgatgagtgagatcacgttcgacgcggacgggtccggggggtcggtgtacggctctgcgggcgtcgcctacggctccggcggtgcggggtacggctcggcgggcgccgcgggtgtctcggatcgctccatgggcggctccaggaggcctgtggacgactcacggggggccgtcggcggctccaaggggtccgcgggcgacaacagggggcccgtgggcggccccagggggcccgtggtcggctctgggcgtaccgctgaaggcgctgaagggcccgccccgctgcacatcgcccagcacgtgctgacgggcgcgctgcgggcggccatcgcgaccgagcgactggtcaaggtcgcggtgcggagccggctggacgcgatcgagcaggaggcgtccggcctcacggcgcacacacgcgacccgaaggggacctggtggcggggcagttacctggtcggctgcgacggaccgcgctcgacggtgcgcaagctcctggacatccgcttcccgggccgtaccgccgttgagcgacacgccgtggcggcgctgcatgcggaacttccctggcccggtgaggcgttgttgcaccggatgccgccgtggcggacgtcgggcccctcggccggggaggtgaccgcacgcccgctgcccgacggcgtgtggcgcctggactggctgttgccgccgggcaaggatctggtcacgcccgagctgctggtgacccgcgtccgggagacgctcgcgggctggagcggaggtcccacacctccgtacgagctgctcgacacgggcgtgcacaccgtccaccaccggctcgcccgccgctggcgggccggccgggtcttcctcgccggtgacgccgcgcacctgctcggtgcgctcggcacacagggtctcgacgagggcctcagggacgccgacaacctcgcctggaagctggcgctggcctggcatcacggcccgcacgagccgctgctcgacagctatcaggcggagcgccgtgcggtcgtcgcggcccgactgcgcgccgccgaccaggcgctgccggtggtgcgcggcggcggagggctgcgcgcgtacgtgcccggctcggcccgcggacacgacgcgctgctcacggacggtcacctggggcgcggggcactgggtacgccggggtcgtacaccgattcgccgctcgcgcctgagcgcgcggactcgacggcccctgtggacacggcaccgggtgcgccggtcgtcgatgtacgggtgacggccgaggacggctccttcgtacggctgcgggaccggctcgggcggggcgcgctgctcgtggtattgatcgcgccgggtacgggtgtgtgggagcgcaagcactgggtgtcggccgggatcatgccccggctcgcggcggcggtgaccgcgttgccgcatcccgccgagctgctggtcgcggagggttacccgggcgcggccgcgcacaccgtgctcctggtacggcccgacgggcacctggtcacggcgctgagcggggtgcggccggccgacctgtacgcggcggcggaggcgacgctgggcgggcctgcggggtcggggagcaaggcggggaccgagacgagggcggagcgggcggcgaccggggggtgaccgtggcgccgcctccgcgggggccgcggttcatctgggcccgctcgcagtggggacgcacggtcaccgtggggtccacatagtgactgtgagtttgaccggcctctgccgtcgtggtgtactccggatcgtgaccgacacctgtgtgcgcctgtggcggagggtccatatggacctcgtccgctatgcgggctgcgtgtgtcgtccgtccagctgaattcgcatctttacttcccgcgcgcctctcgtgtgctgccgcgcgcccctacgcgaacgcatggacggtacccgtgtctgtctctccctccacccctgcccctgcctccgtctccgtctccgctcaggtccccacccaggccgagcttctcgacttcgtacgccgttccgcggccgacgccgagctgatcgcctcgcttccgctggatcccgagggtcgcacctgggtgcgtctggagggccccggcggcagcgaggcctggctgatcggctggccgcccggcaccggcaccggctggcacgaccacgccgactcggtcggtgccttcaccacggcagcgggcgagctcaaggagaactccctcgccgtccggctgccctccgacggctggaggacgctggaactcaccgaaggggtggaccgtgaacggcggctgccggccggcaagggccgctccttcggcaaccaccacgtgcacgaggtgctcaacgactccaccgaggagcacgcggtctcggtccacgcctactatccgcccctgccgcagatccgccgctacagccgtaccggtcaggtgctgcgcctggagcacgtcgagcgtccggaggactggcagtgagctcttcccatgaacgtcccataggtatcgacgagttgctggaacaggtccggaagggtctcgaccgggtggaggcggcggacgcgtacgaggccgcgctggccggcgatgccctgctggtcgacatccggtacgcggccctgcgcgaccgcgacggtctgatccccggcgcgctggtcgtcgaacgcaacgaactggagtggcgcctcgacccccagggcagccaccgcgccgccgaggccaccggccacgacctgcgcgtcgtggtcgtctgcaatgagggctacgcgtcgagcctggccgccgcgtccctgcgccagttgggcctgcaccgggcaacggacctggtgggcggcttccaggcatggaagtcggccgggttcccggtgacggcctagcccgaagagcgccagggcatcgacgtcatgggccatgggcgcgctgggtagacatcgcgacgggggccctctatcggggggccctcttcagtaaggggcgtccgccttccccttctcgccccctttggcccccagcgtcagaacccctcgtcccccaagccttccgtgtcctccccctcttcctccagcgcctgccgaaccacccgcagagccatgccctcggagtagcccttgcgggcgagcatgccggcgaggcgacgcagccgcttgtcgcggtcgaggccgcgcgtggagcggagcttgcgggcgacgagttcgcgcgcggtcgcctcttcctgctcggagtcgagctgccccacggcctcgtcgatcagtgtggagtccacgccctttgtgcgcagctctcgcgcgagcgcccgtcgggccaggccccggccgtggtgccgggactccacccaggcgtccgcgaaggcgctgtcattgatcaggccgacctcctcgaaccgcgacagaacctcgtccgccacgtcctcggggatctcgcgcttgcgcaaggcgtccgcgagctgcttgcgcgtgcgcggggtcccggtgagcaggcgcagacagatcgcccgcgcccgctcagccgggtcccctgggggctcccccttctcggccctcgacgaggcaggggcgcctccgtcctgtgggtcaccggccggctcgccgaacccgcgccgccggccgcgccctcgtcctccttgcgcaccgccgccatcgcgtgatgcgccttcgccgcggtcaccacggaagccgccgtcaccatgccgaccgccacggcgggaccgcgaaccgcgactctgcgaaccgtcgccgtccgcatccccgccgtacgtaccaccggcgccgtatgcctcccgggtcgtcccggataccccgtgagcgccgtacaccccgtgagcgccggatgcctcgtcgtcgtacggctcgccctcgtcgtacgccccgtcgccgcccccgacggacctcccgtcggctccgctcccccgtccctgcggcgcgacggggtacgcgtactcggcccagtcggttcgtcgtgtcatgggctagctcttggccgccgcggccttggacttggtggtcttggccgcgggagcggacaccgtcttcgcggtgtcgtccgtggcagccgcggccgacgtgaccgccgcgtccgcgcccggctccgccgtgggctcctccggccgtacgccgacgcccagcttctccttgatcttcttctcgatctcgttggcgaggtcggggttgtccttcaggaagttgcgcgcgttctccttgccctggccgagctggtcgccctcgtacgtgtaccaggcgccagccttgcggacgaagccgttctccacgcccatgtcgatcaggccgccttcgcggctgatgccctgcccgtagaggatgtcgaactcggcctgcttgaagggcggcgcgaccttgttcttgacgaccttgacgcgggtgcggttgccgaccgcgtcggtgccgtccttcagcgtctcgatgcgacggatgtcgagccgcaccgaggcgtagaacttcagcgcccggccacccgtcgtggtctccggagagccgaacatcacgccgatcttctcgcggagctggttgatgaagatcgcggtggtcttcgactggttgagcgcgctggtgatcttccgcaaggcctggctcatcaggcgggcctgcagacccacgtgcgagtcgcccatctcgccctcgatctccgcgcgcggcaccagggcggcgacggagtcgatgacgatcaggtcgagcgcgccggagcggaccagcatgtccacgatctccagagcctgctcaccgttgtccggctgcgacaggatcaggttgtcgatgtcgacgccgagcttcttcgcgtactcggggtcgagggcgtgctcggcgtccacgaaggccacctggccgccggccttctgcgcgttcgccaccgcgtgcagcgtcagggtcgtcttaccggaggactccgggccgtacacctccaccactcggccgcgcggcaggccgccgacgccgagggcgacgtcgagcgcggtcgacccggtggggatgacctcgatgggctcattcggccgctcgcccaggcgcatcaccgcgcccttgccgaattgccgttcaatctgtgcgagcgcggcgtcgagcgccttctcgcggtcggttcctgccatgggttccacccggtttgcttgagtcgatcgcttcacgtcaaagacgctaacgcctgccactgacaatgcgccccgacgcccgtccggcctgtggataactcggggacttctccatcgaaaccgtgtcgaaatgcccgtcgagagcctcgccggaacctccataagaatggatgttcgattttcgtgtcaagcgcaccacatggcacttccgagggtacgttcgcggtccgacagccctcgggagcagtcacccgacacagcgccgaccggaacgccgagacggccgccgacgccccacccgtcaggccgggccgcgaccggcggatcaggccaaacgtcggatccgccgcacacagaccccggcgagtgcgacggcgaggccgaggaagatgccggtctcggcccactggagggcccagaaatggtcggcgggctgatagatcacccactgccggtaaccggccttgacgaggacggcggtgcatagagatcggccagatgcgggccggtggccgcgaggagtgcggcgagcacgacgacggcgccgaacaccaccgcggtctgggtacggaggtggtgccaggtcgctactcctccgtgagtcgccggggctactcctccgggcgtacgtccattgccttcggccgtacgacgacgacgtgggtcctgcgcacgaggcttgggccatggaaaacctggtttccccggcggttccgggcgccgcgtcggccgcgcgcaaggggccccgccgaaggttcacgacgcgcccggccgaacggttctgctacgcgaccggtgcccttctggttctctcgggcctggcgcatctggtggtcttcgccgtcgacggcggcccctgggacgggcccgtctcctggcgcaagcccgtcacgttcgggctctccttcgggctgacactggtcgccgtcacctgggtcacgtcgtatctgcgcgtcggggcgcgtctgcgcaccgcgctactcgtcgtgttcgccgccgactgcgtcgtggaggtcggcgggatcacacttcaggcgtggcgccgtgcgccctcgcacctcaacatggagaccggcttcgacacactggtctccatgaccctcgcggtgggcggcggcgtcctggtggtcgtgctctcggtgttcgcggccgcggccttccggcaccggcccgagggcccggtggggatgccgctcgcgctgcgctccgggttcgcgatcctggtcgtcgctctgctgtcgggcgccgcgatgatcgcgcgcggggtggtgctgacccgcaccggccaccaggaggcggcgtaccactcgacggccccgctcaagccgctgcacggggtgagcctgcacgccgtgctcgtgctgcccgcgctggcctcgctgctgtcccgcacgccctggagcgacccgcggaaacagcggctcatgtacgtggcggtcggcgcctacgcggtggccgtcctcgcggccggggtctgggccgtcctcacgtactgaacgccggcgagcgagtgccccgcctcgcgcgcctctcaccgctcaccgggacccgtcctcggactcggccgcccggctgcgcccccacagccgacgcacgcgcccgagggcaccgccggagccggttccggggccacggcgccggtgcccgtgcacgcgggggtcgtccgtgacgtcgtaccgcttcacgtacgccccgaggaaggcctgaagggtggcgactgcggggatggcgatcagcgccccgacagcacccaggagcgcggtgcccgcgatgaccgacccgaaggcgaccgcggggtggatgtcgacggtcttcgaggtcagcttgggctgcagcatgtagttctcgaactgctggtagaccacgacgaagatcagcacccacagcgcgtaccagggattcacggtgaaggcgatcagcatcggcagggcgcccgcgagataggtaccgatcgtcggaatgaactgcgagaccaggcccacccagacggccagcacgggcgcgtacgggatgcccagcgactgcagcaggatgtagtgcgctatgcccgagatcagcgccatcaggccgcgcgagtacagatagccgccggtcttgtcgacggctatctcccacgcgcgcagcacctcggcctgccgggcgggcggcagcacggagcacagggcgcgccgcagccgcggcccgtcggcggcgaagtagaaggagaacagcgcgatcgtcagcagctggaagaggcctcccaggacctgcgcggacacgtccagcacacccgtggcgctgttctggacgtaccttcgcagccagtcggagtggacgaggctgtcctggatgtcgacccgtcggagatccgtgtggaaggtcgtgttgacccagctgatgacggagtcgaggtagtcggggaagccctcgaccatcttgatgatctggcccgcgagcatcgagccgagcagggtgacgaagcccgccgtcacgatcatggcgccgaggaagacgaggaaggtggccagccctctgcgcattccgtacccggccatccagctcaccgccggctcgatggcgagcgccaggaagaacgcgatgagaatgttgatcagcaggccggtgagctggtgaaacgcccaactgccgaactggaagccggcgataagggcgagggcgagcaccatggcacgcggcagccagcgcggcatgcgtccgccccgtccggcggcgtccccggccggtgggtctgcgggcggcgtcgtgccgaacggcgatacgtgctgggcgaccttcgcggtctcatctgtcggggccacggtgcaagtctcgcccacgccaccgacaaccgactgccacccccggatcttcatgaccggaacgtcccgacgcacgatcggcacgcactgatcaccaggtcactcagcggttctcctgcggaacgttcatcgccgtgcacaccgcgcgccacacgtccttggcctcccagccggcctccagggccttgtccaccgtgcgcccacccaactccgacatcacgtgatcgcgcgcgaaggtctccgcgtaccccgcgccgaagtgatccgccatccgctgccagaagaccgtcaaccgcatgactccagtatcccgcccctgagggtgggccctcgccgggaccgcttgccgagaacgctttccgtcctacggtctgatccatggccgaaacaggagcatccccactccccccgacgccctcggcgcgctccccgctgtcccgcgccgagcacttcgtctggctcaccgcgcgcgtgctggagcagcgccgcttcgcgtaccacttcctgggtggcaccgccgacgcggtggagaccgcgctggccgcctaccgcaacgaggacgacgggtacggccacgcgctcgagcccgatctgcgcggcccggtcagtcagccgttgcacgccgggcacgcgctgcgtgtactggactcgatcgggcgctgcggcgggcagcgggtggagcgtgtgtgccggtatctgacgtccgtctcgacgctggacggcgcgcttcccgcgatccggcccagccagcgcggctatccgacggcgccgttcgtgccggtcgtcgacgatccgcccagcgaccttctcgccaccggcccggtggtgggcctgctgcaccgcaacgaggtgtggcacgcctggctgttccgggccaccgacttctgctggcaggccgtcgagtccctgcggaagtcgcacccctacgaggtcgaggcggccgtggccttcctggattcggcgccggaccgcccccgcgcggaggcggccgccgaccgtctgggccgtatggtgcgcgagcagcggctcgccgtcctggacccggagcgcctggacgcgtcccccgtatcgcccgggtacgggccgggcgaacatcacttcccgtacgacttcgcgcggactccgggctctctcgcgcgcgcgtggttcacggacgaggagatggcccgctcgctcgacttcctggcggccgaacagcggaaggacggcggctggcccattcgctggcgccagtgggcccccggcaccgctctggagtgccgccccatggtgacgatcgaggcgctgcgcaccctgaaggcgtacggacgggccatcgcctgagggcaaagccgggccgggcgggggtgccggcgctcagcccgccatcgcccgcacgcccgccgtcaccaccaccgccgcggcgacgaccaggaggaacggcgcacgcagcacgagcgccacagcggccgcggcgagaccggccgccttggcgtccagcaccagcgtgcggccgtcggcgaaggtctgctgggcggtgagggcggcgagcagggcaacgggcagcagggccgcgagccgtctgacgagcggccgctccaggacgcccgcggggaccagcaggccgatgagcttgacggcgtagcagccgacggcggtcgcggcgatcgcgatccagatgttcaacgcgcttccctccgggtgtcgtgggcggaggtcgcgtcacaggcggaggtcctcatgcggcgcccttctacgtagaggacggtcggggcggccagcgcggccaccaggaccggcacaccggcgggcagtacggggagcaggccgagccccaggaggacggcgatgcccgccaccgcccgctccgccgcggtcttcagcatcggcgcgagcagcgccaggaagaccgcgggcccggccgcgtccaggccccacgcgtcggtgtcgccgatggcctgcgcaccgaccgcgccgatcagcgtggtgaggttccacagcacgtacagcgagagtccggtgaccgtgaagccgatacggacgctgcgccgggtgggctgggccagcgcgacggcggtggtctcgtcgatgacccactgggcggcgaacgggcgcaccgcgcgcgggagggccagcaactgcgacagacgcagcccgtagaaggcgttgcgcacaccgaggaagaaggctcccgcggccgccgcgagcgggttgcccccggcggcgagcgcacccacgagggcgaactgtgaggcgccggtgaacaccaggaggctgagggcgcaggtctgtagcaaggacagcccgctgccggccgaggtcaccccgaaggcgaagccggacagtccgacggcgaccccgactcccagggcgtcccggacgacggcggcgtcgggttttccgccgtcctcactgcgtatgtctgcgagagctgtctgttctgccacgcctcggacggtagccgcgggcgcgcccgtgggtcttgtacgttcttgcacgctcccgcggccgtgcccgtacgctcccgcggcggttccctcacacacccgtgtccatgttcttgcgcgcgcccgtgcggccgtcctcgccaccgagcaccggacgggcgtcgctgccgcgctcccgctgatacgcgcccgggggcacgccgacgatccgggtgaagtggcggttgaggtgcggctggtcggtgaagccgacggcgacagccacttcggcaggcgcggtaccggcgtccaggaggcggcgggcacggcgtacacgggcgtcggtcagccaggtgtggggcggcatgccgtacgcctcccggaaggcgcgcagcaaggcgaagggactggcgccgaggtcgccggcgaggcgctccagggtcggaggctcggccatgcgctcttcgagcacggtacgcgcacgtacggcgatgccggcacctgcgctacggacctcgcgctgtggcatcggtcccccgttcagccggagcaacctggtcacggcaacccgcagcagggtgtcggcggcgagcgcgttgccctcgtcggcggcgcggagcacctggtggaccaggccggccgcgtacgcgtcgtcgagcaccgggctggtgaagccgggcgtgccgcggatcgaggtggtctcggccgcgatctcggccaccagttccggcgacgggtagaccgccccgtaccgccagccctcggggacgcccgcgcggccggtgtgcggggtgtcggggttgaccagcgcgagggcgcccgggcccgcgtactggtcggcgccaccgtgatggaagacctcgacgccttcggcgatggccgcgatgacgaagttctcgtgggtgtgccgtacgaagatcttctcgatgtagctggcccgcagcaggtcgacaccgggcagttccgcgtaccgccagtgccgtgcccgctccttccccgtgcctgccatgccctcattctccgccacccgacgcaccccgctcgcggccccagccacaccccccggccgcccctgagcggcccacctgggctgccgaggcggaccacccgccgccccacacccgcgcacggcccaccccacggccaaaccgctcaccccacccccactcggaccattgtcgcaggtcagagccgttgtcagtgcgtgggtgcaacatggacgcatggtcagttccacacaccgagccctcgacggcttctcgcccgcgacccgcggctggttcacgggggcgtttcccgcgcccaccgcggctcaggccggcgcgtggcgtgccatcggcgagggctcggacgtgctcgtggtcgccccgaccggctccggaaagacactggccgccttcctcgccgcgctcgaccagctggcgtccgccccgccgcccgccgaccccaggaagcgctgccgggtgctgtacgtatcgcccctgaaggccctcgcggtcgacgtggagcgaaatcttcgcagcccgctgaccggcatcaggcaggaagctgtgcgcctgggcatgcccgagcccgaggtgaaggtcggcatccgctcaggggacaccccgcccgccgagcgccgcgcgctgtccacccgcccgccggacatcctgatcacgaccccggagtcgctgttcctgatgctcacgtcggccacgcgggacgcgctgacgggcgtggagacggtgatcctggacgaggtgcacgcggtcgccggcacgaagcgcggcgcgcatctcgcgctctccttggagcggctcgacgagctgctgcccaaaccggcccgccgcatcggcctctccgcgaccgtgcgcccggtcgacgaggtcgcccgctatctctcaccgcggcgcaaggtggagatcgtccagccgaagtccggcaaggagttcgacctctccgtcgtggtcccggtcgaggatctgggcgagctgggcggctccccggtcgccgacggcagcgagggcgccgagcggccgtcgatctggccgcacgtggaggagcggatcgccgacctcgtccaggcccaccgctcgacgatcgtgttcgccaactcccgccgcctcgcggagcgcctgtgtaacaggctcaacgagatcgcctacgagcgggccaccggcgagcctttggacgagcaccacgccccggccgaactgatgggcggctcgggcgcggcccagggggcgcccgcggtgatcgcccgtgcccaccacggctcggtctccaaagaacagcgcgcgctcgtcgaggaggatctcaaggcgggccgcctgcccgcggtggtcgccacctccagcctggagctgggcatcgacatgggcgcggtggacctcgtcgtccaggtcgagtcgccgccgtcggtggcttccggcctccagcgcgtcggccgcgccggccaccaggtgggcgcggtctccaccggcgtcgtcttccccaagtaccgcggcgacctcgtccaggccgccgtggtcacggagcggatgcgcaccggctccatcgagtccctgaaggtgcccgccaaccccctcgacgtgctcgcgcagcagctcgtggccatggtggccctcgacacctggcaggtcgacgacctgctgaccacggtccgccgcgccgctcccttcgcctcgctcccggagtcggccttcaccgccgtgctcgacatgctcgcgggccgctatccgtccgacgccttcgcggagctgcgcccgcgcgtggtgtgggaccgcgtcgccggcacggtcaccggccgcccgggagcgcagcgcctcgccgtcacgtccgggggcacgatcccggaccgtgggctcttcggggtcttcctcgccggcgcggaccccaagaagggcggtggccgggtcggcgagctcgacgaggagatggtgtacgaatcccgggtcggggacgtgttcaccctcggcaccagctcctggcgcatcgaggacatcacgcgcgaccgggtcctggtctcccccgcccccggagtcccgggccgtctgcccttctggaagggcgaccagctgggccgcccgctggaactgggccgcgcgctgggggcgttccttcgtgaggtcggcgcgctcccgaaggacgacgcccggctgcggctgctggcagccggactcgacgcctgggccgccgacaacgtcctgtcgtacctggccgaacagcgcgaggcctgcggacacgtccccgacgaccgcacgatcgtcgtggagcgcttccgggacgagctcggcgactggcgggtcgtcgtgcactctcccttcggtgcccaggtccacgccccgtgggccctcgcgctgggcgcccggctcgccgagcggtacggcatggacgcccaggtcatgcacgccgacgacggcattgtgctgcggctgccggacgccgacctgatgggcctggacctgctcgaccaggagcccctgaaggccggcgcccctctggacacagcgggcgccgagcaggcgcccatcggtgccgcggacgtcgccttcgacaagggcgaggtcaaccagatcgtcaccgaccaggtcggcggctcggcgctgttcgcgtcccggttccgtgagtgcgccgcccgcgcgctgttgctgccgcgccgcagccccggcaagcgcaccccgctgtggcagcagcgccagcgtgcggcccaactgctccaggtggccagcgagttcggctcgttcccgatcgtcctggaggcggtccgcgaatgcctccaggacgtcttcgacgttccgggcctcacggagctgatgggcgacatcgagtcccgcaaggtccgcctggtcgaggtcaccacgccggagccgtcgcctttcgcccgctccctcctcttcggatacgtcgcgcagttcctctacgagggcgactcacccctcgccgagcggcgcgccgccgcgttgtcgctggactcgcggctgctggccgagctgctcggccaggcggagttgcgcgagctgctcgacgccgatgtcctgacggagctggagcgcgagctccagtggctcaccgaggaccgtcgcgtcaaggacaccgagggcgtcgcggaccggttgcggctgctgggccccttgaccgacgccgagctggccgagcgcggggccgagccgcagtgggcccaggagctggccggggcccgccgcgccatcaaggtccgcatcgcgggcaccgaccactgggcggcgatcgaggacgcgggccgactgcgcgacgccctcggcacagcgctgcccgtcggcgtccccgaggcattcacggagccggtcaaggacccgctcggcgacctcctcgcgcggtacgcgcgcacgcacggcccgttcacctcaacggccgctgccgcgcgcttcggtctcggcgtggccgtcaccgagggcgcgttgcagcggctcgcggcggccggccgggtcgtccagggggagttccaccctgcgggcatcggccaggagtggtgcgacgcgaccgtgctgcgccggctgcggcgccgctccttggccgccctgcggcacgagctggagccggttccgcccgccgcgctcgcgcagttcctgccgcagtggcagcacgtcggcggcggacatgggctgcggggcgtcgacggcctggtgcgcgcgatcgagcagctccagggcgcctccgtgccagcgtccgccctggagaagctcgtcctgccgtcacgcgtctcgaactacacgcccgcgatgctggacgaactcaccgccgccggtgaggtggtgtgggccggggccggttcactgcccggcaaggacggctgggtctcgctgtacatggcggacgcggcccccctgctcctgcccgccccgcaccccttggagccgaccgcgctccaccagtcggtcctggacgccctgtccgggggttacggcctgttcttccggcagatcaccgatcaggtccgggccaccacgcaccccgacgccaccgatccccaactggcggacgtgatctgggacctggcctggacgggccggctcacgaacgacacgctcgcgccgatgcgttccctgctcggctcgggccgcaccgcgggctccaccgcgcaccgcgccaagcgtgccgtcccgcgcgggcggtacggctccctgacggccaccgcgcgcccccagtcccgtacgggcccgccgaccgtcgccggccgctggtcgctgctgcccgctctcgagcccgacaccaccgtgcgcgcccacgctctggcccgcaccctgctggaccggcacggggtggtgacccgcggagccgtcgcggcggaaggcgtcgagggcggcttctcggcgacgtaccgcgtcttgtccgtgttcgaggagagcgggcaggcgcgccgcggctatgtggtcgaggggctgggcgcggcgcagttcgcgatggacggcgcggtggaccgcctgcgcgcggcggcgaacgcgcgggagagggacgagacactgcccggcccggaccgttcggacggcttcgccgggggcgccccccatcggctcgacgcggcccgtccgttcgcccctgcggcggctcccggttccggagatggtttcctcgacaggttcgacccgcagttcgactccaacctgggcgccttcgccgacctctccgacactgccgacgcgcagcccgtctccagccacccggggacgcaggcagcccccggcctccccgaggtgcagccgggtccaggccttccccgcgcgcaagccggcccccgctccccgtacggccagggtcttcccccgaaccgcactcgctccgccggcgcctcccgagccgtcgtcctggccgcggcggaccccgcgaacgcctacggcgcggccctctcctggcccgaacccccgaccggggcgggacacaagccggggcgcaaggcgggttccctggtcgtactcgtcgacggcgagctggcgctctacatggagcgcggcggcaagacgctgctggcctggccctccgaccccgacgccaagacgacggacgatccccgtctactggccgccgccgaggctctcgccgcgtccgcccgcgcgggttccctgggcacggtcaccgtggagcgggtcaacggcgcctcggcgctcacctccccgttcggcaccctcctggaaggagcaggcttcatcgcgacgccccgcggtctgcgccttcgcgcgtgaggacgaggcacgggaggacagaccacggcagagcaggcaccgggacacgccagagagcggcgggacagcgcggcgcgggcccacgaggcgcggcgcaggagcacggatcgcggcgcgcggcgcaggcccacggagcgcgggacggagtggcggagcaaagccgctcgcgccacgtccggcccccggcatgccacccttgagccatgcccgaaggcgacaccgtctaccaagccgcgaggcgtctgcacagcgccctcgcgggcaaggtactgacccgttccgacctccgggtgccgaaattcgccacggccgacctcaccggccgcaccgtactggacgtcaccccccgcggaaagcacctcctcacccgcatcgagggcggcctcaccctgcactcccatctgcggatggacggttcctggaaggtgtacgcgccgggccagcgctggagcggcggccccgcacaccagatccgggcgatcttcggcaccgcggaccgcacgtccgtgggctaccgcctccccgtcctcgaactgctccgcaccgccgacgaacaccgcgccgtcggccatctgggccccgacctcctgggccccgactgggaccccgaccgggctcgggagaacctcctccgcgacccggcccgccccctcggcgaggccctcctcgatcagcgcaacctcgccggcatcggcaatgtctacaagagcgagctgtgcttcctgctccgggccactccatggctccccgtcggtgacctcccggccgagcacctcgcccaactccccgccctcgccaagaaactcctggagaccaaccgcgaccgcccggcgcgcagcaccacgggccgccgcgagcagaggctcttcgtgtacggccgcgcaccccgcccctgtctgcgctgcggcacccccgtccgggtggccgaccagggcgacggttcccgcgagcgccccacctactggtgcccggcctgccagccggggcccactccggccccgggcgcccacgcacgaaggccaagccggccacgtatcactaattgacgacccgtcagaaaccctcgtaccgtcgatgtcatgcccgtcaaggcgtacgacctcaccggacgcaccgcattcgtcaccggcgccgccagcggcatcggccgggcctcggccgtactgctcgcgcaggccggcgccaccgtgcactgcgcggaccgcgacgagcagggcctgcacgagacggagaccctgatcaagggcgggggcggcaccgcccgcacccaccacctcgatgtcaccgaccgggcgcggctgcaccaggccgttgccggatgcgaccgactcgacatcatggccgcggtcgccgggatcatgcacagcagtcccgtgctggagacgcgggacgaggacctcgaccgggtgctgaacgtgaacttcaagggcgtgctgtacgcctgccaggaggcggcccggcggatgatcgcggacggtactcgcggcagcattgtcaccatggcctcgggagccgtcgacaccggcggccccggactgctctgctacggcgcggcgaaggcggccgtggtccagctgaccaagaccctggcgaccgaggtcggccggcatggcatccgggtcaacgcggtggcgccgggctgggtgcgtacggccatgacggaccgccatgacggggcggcgcaggcgcatacggaggcgttcatggccaggttgtcaccgctgggcagggtcggtgaaccggacgacatcgcccacgcggtactgcacctggcctccgacgcctccccgttcaccacgggccagatcctccggccgaacggcggagtggcgatgccctggtagaccaggccccgacggccgggtcgcccaccccaaaacggcggcctggtcgccaaaccccaacagcccacaccccagccccagcccacaggcaccatgcggcgaatcccccgacacccgcgaagcccccacctcccccgcgtccaaccacgcgacaggcgccgcgacactcctccagcacccagcgccaccgggtcaggcgcgcggcgcgtctcccccacgccgcacctccgcgcgcccttcccgcgacctccactgctgccaggacaccgcccactggtccgagccggccgctcctgccacccgggccttcggcacacagtgcaccggcagcaggctcagcccccaccccccggccacgacggctccctccagcaccccggaatcgggcaccagtacgagccgtagtaccccccaccaccacagcgcgccgagcgccagcgccaccccccagcgcgctattcgcccagccatcgccgcctcctccagcccgacgctagaccgcggctctcccgcaccgggagggcgcaccgacggcacaccggcgcactgccgcacccgtcaactccggcccctcgcacggagggcgcgcccgccggcctcaccgccgcgcacacgcgccccctcccgtacccgcacacgcgccggtaccgcggccttgccgcggcgcgcggctcacccgttctccgcctggaacatccagtggtgcttctccagatcggcggtgatcccgatgaagatgtcctggctcacggggtccgcgtccgccgtcgaccccacgcgctcccgcatacgcgagatcaccgcgcccagcgcggtgaccagcatgcccaccgcgtccttgtcctggatccagcccgcggccgtctcaccgatgccactggtgttcgccacggtcacggcgcggccgtccggggagacacccagggtcgcggcgcgctcggcaaccgtgtcggagtgcagcctcgcggtgtcgacgacgtcgtcgagttgcaggtgaatggagcggaagcgcggtccgatgacgttccagtggacctgtttcgccacgagtgacagatccaccaggtcgaccagcgcaccctgcaatgcctcggccacggtcttcaggtccgcgtcgggcagcgggctcttcacgacatacatcggcgatctccgaatcctcatgcgtccgtcgtatgacccgagtaccccgtatttccaccatgaccgcctcgccccgccccggcaaacggggccgtccggcaacgcgagagccccggccacgcctctccggggttcccggagaagccccggccggggctctcgcacgagctcgtcggctcgtgcaggttcttgcatgggtcctgcgcactcagcacgcgaattctctcgcgcgcgcccgtgagtgtcaggcggcgaccacgtccactgcctctgtgggcgccttgatcgtgacccgttccggtggcacaccggcgacggacacggagttgagcatcgggcgacgtaccggtgttggtaccggttcggtggccgcagccgactgtgccagctcggcgagggcgagctcgtcgctcacttcccgcatgagctcggacatccgtacgtccagcgcgtcgcagatcgcggagagcagctcggaggatgcctccttctgcccccgctccacctcggagagatagccgagtgagactcgggcggacgaggagacttcgcgcagagtacggccctggcgctggcgctgccgacgcagcacgtcacccagcaggcgacggagcagaatcatcggtggctccctcctcggaccgcgtagccgcatccttcacgccccaccgtaccgccttgcgccgcggccgtgcggggagcgatgtcgtgttcactcagggctgtaaacatcaagtccccccgttctcttccgtatcctgtgcccgctcattcccggtctgttcgcccgcgagctccttcaggagcagtgcgagtacgctccgtacactctccatacggatttccgcacggtcgccgttcaaccgcagggacgccactttcccgccaccgctggaactcccggagcccgcgaagggcccgtcgacggccacgaaaaccgtgccgaccggctgtccgtcctgtgcctccggccccgcgacacccgtggtggaaatcccccagtccgcgcccatgaccttgcggacgccgaccgccatctgggcagcgacctgcggatccaccgctccgcgctcggccagcagagtgctgtcgacgccgaggatgtcccgcttcacatcggtggcgtacgcggtcaccgagccacggaagctcttggaggctccgggcgccgcggtgatctccgccgccaccaggccaccggtcagcgactcggcgacggcgagcgtctcgcccctcactccgagtagtcgcagcacttcagtggccagggaattcaccgttccgcctcctcggccgcggctttgcgctcggcgattccctgcctgcgcagcacaatggcctgtctcacatagtcgagcccggtgaccacggtcaggacgatcgccacgcccatcacccagaacctcagggtcgccaggggtcccgtcagcgccagcacgtacatcccgacggccacgccctgggtcaaggtcttcagcttgccgccgcggctcgccgggatgaccccgtaccggatcacgacgaaacgcagcagggtgatcccgagctcacgcccgaggatcaccccggtgacccaccacggcagatcgccgagccaggacagacagatcagtgccgcacccatgatcgccttgtcggcgatggggtcggcgatcttcccgaagtcggtgaccaggttgtacgtacgcgccagatggccgtcgaagatgtcggtgatcatggcgacggcgaaggccgcccaggcccacgcgcgccaggcggggtcatagccgccgtcggccagcatgagtgccacgaaacccggtacgaggaccaggcggagcatggtcagcaggttcgcgacgttccagacgctggcctggttgacggccgcggcgcccagctttccgccccgcacctgccgcgtgctctcatgaccggcggaagctccgccctgggcgccctgtgtgccggcggcgccgtcatccacgctctgcgcaccggaggagccgcccgccgcgttcctcgcggtcatcgcgcccggaacgccggcggctcccttggccccggaggcgcccgccgcggaggccgcaccccgtgcgccggcggaaccgcccgccgcggatgccgggactccggtcatctgcccgcctcctcagtacacacgagcgaccccgggagcggctcggccacgaggtcgacaccttccgtaccgaccaccttcgcctcgaccatacgaccgacggtcagaccttcgccgctcgtgaacagcacctggccatccgtctcgggcgcctggtgctcggcgcggccgacggcgccctcttcgtcgtcgatggactcgaccaggacgtgcacggtctcgccgacccgctcctccgcgcgctgcgcgaccagttcctcggccagccgggagacccgcgcaagccgcgcggcgacgacgtcctcgtccagcttgtggccgtacgtcgccgcctccgtgccctcctcgtcggagtacccgaagacgccgatcgcgtccagccgtgcgcccgtgaggaaccgctccagctccgcgaggtcggcctcggtctcgccggggaagcccacgatgaagttggagcgcacgccggcctgcggggccttggagcggatcgtgtcgagcagctccaggaagcggtccgtgtcaccgaagcggcgcatcgcgcgcagcacgtcgggcgcggagtgctggaaggacaggtcgaagtagggcgcgatcttcggcgtggaggtcagcacgtcgatgagccctggccgcatctccgcgggctggaggtagctgacgcggacgcgctcgatcccgtccacctcggcgagttcgggcagcagggtctccagcaggcggatgtcgcccaggtccttgccgtacgaggtgttgttctcggagaccagcatgacctccttgacgccctgctccgccagccagcgcgtctcaccgagcacgtcactggggcgccgggagatgaaggagccgcggaaggaggggatagcgcagaaggagcagcgccggtcgcagccggaggcgagcttcaccgaggcgaccggggaaccgtcgaggcggcggcgcaggggtgcacgggggccggactcgggcgccaggccctcgggcaggtcctccggcaggccctcgggggcaccgtgccccggaagtgccacgtccgcgcccgcgctctgccgctccgcggggctgatcggcagcagcttgcggcggtcgcgcggggtgtgggcggcgtggatgccgccgttcaggatggtctggaggcggtcggagatgttcgtgtagtcgtcgaagccgagcacgccgtcggcctcggggagggcctcggccagctccttgccgtaccgctcggccatgcagcccaccgccacgacggcctgggttctgccgtgtcccttgagatcattggcttccaggagggcgtcgacggagtccttcttggcggcctcgacgaagccacaggtgttgacgacggcgacgtccgcgtcctcggcgtcctccacgagttgccagccgtccgcctccaagcggcctgcgagctcctccgagtccacctcgttacgggcgcagccaagggtgacgagtgcgacggtacggcgttcaggcatgggctcaagactacttcgtcccgctgacagcccacgtcgacggggttggccgatcttggccaaccccgtgtgctcccgcccttgattgcctgctgtgccccttcgggcccgtcatccggcctgggggtcgcccttggtgtatgtgaggcgctccacctggccggcctggaactcgtcctggatctgcttgccgttcacgaacagctggaccgcgcccgcgtcaccgaggacgagctcgatcttctccttgtcctggaaggtcttggagtcgcccttctccagggtgccgtcgaacagcagccggccgttgtggtccttggcggagatccagctgcggccgtcggcggcgctcacctggacggtcaccttgtcgcggggcgcggccgcgatggcgctgtccgagacgtcgggcttggggtcgacgggcttggccttcttgggcgtgggcgaggcgggcttgctggtgctcggcgtggagccctcggcgacctgcgtcttcgtgccgtcgccgccgccgctccccttgacggcggtgaacccgacgaagccgatcaccgcgacgatcgccgcgaccatggccgcggtccagttgggcccgcgccgctccggacggatgcgctcggcctcgaagagcggggcggccggggtcggggcggggcgcccgccgtgatcggcgtcgtactgggcgagcagcggcgccggatcgatgcgcaccgcgcgcgcgagggtgcgcaggtgaccgcgcgcgtagacgtcaccgccacagggggcgaagttgtcctgctcgatcgcgtgcacgatggcgatgcggacccgcgtggcgttgctgacgtcgtcgacggtcagcccggccgcgatgcgcgcctgctgcagagcacggccgatcgaggggcgatccgccgcacgggcgtcttcacgatcgctttcgaacggacgctcgtcctcaggggagttgccgtcaggggagttgccgatggacacgggggcgcctttcgagcgtgtagccacctgtgctggaagttcagtctagggggggtacgaaagggtggggcaaccgggcggtaggactttgtacgccatcagaatggccggtcatcctgatgctgggacatgctcctgcccctccctcaacttgacgtacgccgaagggaaacggttgctcacagatcccttacgggtgggtcacgttcgcatacccacgcacgacgcgcccattccgtacggcgtccggaatcgcccgaatgcctacggcgcagcctccccgcgaatcaccgcgagcacgccatccagctcgtcggccttcaccagaacgtcacgtgccttggaaccctcgctcgggccgacgatgttccgggactccatgagatccatgaggcgccccgccttggcgaacccgacgcgcaacttgcgctggagcatcgaggtggacccgaactgcgtggagaccaccagctcggccgcctggcacagcaggtcgaggtcgtcgccgatgtcctcgtcgatctccttcttctgcttggtgcccacggtgacgtcgtcccggaagacgggcgccatctggtccttgcagtgctggacgacggcctcgacctcgtcctcggtgacgaaggcgccctgcatacgggtgggcttgttggcgcccatcggcaggaagagcccgtcgcccttgccgatcagcttctcggcgccgggctggtcgaggatgacacgcgagtcggcgagcgaggaggtggcgaaggctagccgggagggcacgttcgccttgatcagaccggtgacgacgtcgacggacggccgctgcgtggcgagcaccaggtggatgccggccgcgcgcgcgagctgcgtgatgcgcacgatggcgtcctcgacgtcgcgcggcgcgaccatcatcaggtcggccagctcgtccacgatgaccagcagatacgggtacggcgacagctcgcgctcactgccctcgggcagcttcaccttgccgttcctgatggcctcgttgaagtcgtcgatgtgccggtacccgaacgccgccaggtcgtcgtagcgcaggtccatctcacgcacgacccactgcagcgcttcggcggcccgcttggggttggtgatgatcggcgtgatcaggtgcgggatgccctcgtacgcggtcagctcgacgcgcttggggtcgacgaggaccatccgcacgtcctcgggggtcgcgcggaccatgacggacgtgatcagacagttgatgcaggacgatttaccggagccggtcgcacccgcgacgagcaggtgcggcatcttcgcgaggttggccatcacatagcccccctcgacgtccttgccgagcgcgaccagcatggggtggtcgtcctcggcggcgtccgcgaggcgcagcacgtcaccgaggttgaccatctcgcggtcggtgttcgggatctcgataccgactgcggacttgccggggatcgggctgatgatccgcacgtcggggctggcgacggcgtacgcgatgttcttggtgagcgcggtgatccgctcgaccttcacggccgggcccagttcgacctcgtagcgcgtgaccgtcgggccgcgggtgaaacccgtgacggcggcgtcgaccttgaactccatgaagacgttcgagagggaggcgacgacggcgtcgttggcggcgctgcgcgtcttgccggggccaccgcgctccagaaggtcgagcgacggcagggagtaggtgatgtcgcccgagagctggagctgctcggcacgcgcgggcaggtcccgcgtctcggccggcggcgccttggtgaggtccgggacccccgccttcgacgcctccttcctgggcggcttcaccgccttggcgcgtgcggccggtacgggtgtcgtctcctcgtacccgtcacgctccacggtgacgccctgcgtcagatcggcgaccagcggggagggcggcatgccgtgcaggacggcgccgtcgagggcggcagcggcggctgcggcgacgtccacggcatccatgggccggttcaggtcgggctgctgcccggcggagcgcctggggcggctgcggcgcttggagagtgcctcctgctcgtccccgtccgggtcgtagcccgcgggggcgggcccgcgccgccgggcgttcgggggcagcgcctcgcgccactgctcgtcgtagcgctcgtcgtcctcggcgagtccctcttgcgcgtcgtggacgacgccgagcctcacgccgagcagccgcagccgctgcgggatcgcgttgaccggggtcgccgtgacgacgagcagcccgaagacggtgagcaggacgagcagcgggacggcgagtacgtcacccatcgtgtacgtcagcggagtggccgcgctccagccgatgaggccgccggcgtcccttatcgcctgcatgccgtcgctgcgcgcgggcgccccgcacgcgatgtggacctggcccagcacgccgatgacgagcgcggacaggccgatcacgatgcgcccgttggcctcgggcttctccgggtgccggatgaagcgcacggcgatcaccgcgagcagtatcggcacgagcaggtcgagccggccgaaggcaccggtgaccagcatctcgaccaggtcgccgacgggtccgcgcagattcgaccaggtacccgcggcgacgatcagcgcgagcccgagcagcaggagcgcgagcccgtccttgcggtgcgccgggtcgagccccttggcgccctgccctatgccgcggaacatcgctccgacggcgtgcgcgactcccagccacagggcgcgtgcgagcttgtacacgcccccggtgggattgggcgccggcttcggagcgggcttcttcgccgcgaccttcctggcgggcgccttcctgacggctgcctttttcgcgggggccttcttcgccggagccttcgtcggaacggccgccttcttcgcgggcggcttcttggctgcgggctgacgtgaggccatgagtgtgaggttaccggtggagacggcaggggacacgtgtgcctcccgcttcacccgttcgtgtcgcccttgccggggcgcgaaactgacgcggactcatgagagcggcgcgggccgaagcccgtcgccgcactcgctcccgatcagttcggcgacggcagcgagggcgctccgctcccggtgcccggctccagggcgtccagcgccctgcgcagacccgtgagtttgcgttcgagatgggcggcggtcgccaccgcggccgcatccgccgagtcgtcgtcgagctgcttcgacagcgcctcggcctgttcctcaacagccgcgagccgtgcggagagttcggcgagcagtcccgccggctccttggtctcgccgacggcgaccttgccgccaccaccctccagctggagccgcagcagcgccgcctgctcacgcagttggcagttcttcatgtacagctcgacgaacaccgagaccttcgcgcgcagcacccacgggtcgaacggcttggagatgtagtccaccgcacccgccgcgtacccccggaaggtgtggtgcggcccgtggttgatcgcggtgaggaagatgatcgggatgtcccgggtccgctctcgccgcttgatgtgcgcggcagtctcgaaaccgtccatgcccggcatctggacgtccagcagaatgaccgcgaagtcgtccgtgagcagtgctttgagtgcttcttccccggacgatgcccgcaccagtgtctgatcgagcgcagagaggatggcctccagcgccagcagattctccggccggtcatcgaccaggaggatcttggccttctgcaccatggcccgccctcctcgccccggcatggggcctcccctgtccgcaggacttggggaagcaccgggcgccgccccaggggacgactcccttgcgccgcccgtccttgtgccggtcatggtagccgcaccccgcctgtcgccacaccctgtcaccgcgatgtcactgtgcacgtagcagaaacgtagcgggagaccagaaggttccccgaatcccgcactcctacacggcgtccgacacactcagtcagcaactccgtgtgaacgtttcgcgttcccgtcactccgcacgcatccactgttccatcacggtgagcagatgatcggggtcgaccggcttggtcacatagtcggacgctcccgactcgatggccttctcccggtcgcccttcatggccttggcggtcaacgcgatgatcggcagtccggcgaactgcggcatccgccggatcgcggtggtcgtggcgtatccgtccatctcgggcatcatgatgtccatcaggacgaccgtcacatcgtcgtgctgctccaggacctcgatgccctcgcggccgttctcggcgtacagcaccgaaagaccgtgctgctcgagaacgctcgtgagcgcgaagacgttccggatgtcgtcgtcgacgatcagcaccttctcgccgtcgaaccggatcccccgacgcggctgcggcgccggctcctgctgccccgcgcccacccactgctcctgcccctgggcgggcctgcccggcagcgcggtccgttcctcggccgcggtcaccgccctgcgacggcgcctgaagagcgcggcgggcccgttctgcgtgtcgcggtacgacttcacctcggccggcgtctcgatgtccggcgcggacagctccggctcggacgccagcagctcaccgacctccatcgtgggcgccatctgggcgtaaccctgcggcggcagttcactggggtgcagcggcaaatacagcgtgaacgtcgagccgcgtcccggctcgctcgccgcgtggatctcgccgccgagcagacgcgcgatctcccggctgatggacagccccagacccgtaccgccgtacttgcggctcgtcgtcccgtccgcctgcttgaacgcttcgaagatcacccgcatcttgctggccgcgatgccgatgccggtgtcggtgacggagaacgcgatcagaccggcgtccgcgtcccgcagcgaacctgcctccaggagctgctcccggatggccaccggtacgtccgcgcccgcgggccggatgaccagttcgaccgctccggagtcggtgaacttcaccgcgttcgacagcaggttgcgcagcacctgaaggagccgctgttcgtcggtgtgcagcgtggcgggcagttccggcgagacccgtacggagaagtcgaggcccttctccgccgtcagcggacggaaagtggcctctacgtagtcaacgagttggacgagcgcgatacgcgtcggcgacacgtccatcttgccggcctcgaccttcgacaggtcgaggatgtcgttgatgagctgaagcaggtcggagcccgcgccatggatggtctcggcgaactcgacctgcttcggggtgaggttcgagtccgcgttgtcggccagcaacttggcgaggatcagcagggagttgagcggcgtacgcagctcgtgcgacatgttcgccaggaactcgctcttgtagcgcatggagaccgcgagctgctcggcacgctcctccagaacctgccgcgcctcctcgatctcggtgttcttgacctcgatgtcgcggttctgctgcgccagcagctcggccttctcctccagttcggcgttcgacgcctggagggccttctgccggttctccaactcggccgaccgctcccggagttgctcggtcagctcctgcgactgcttcagcagcacctccgtcttggtgttgacggagatggtgttgacgctcgtcgcgatcatctcggcgatctggttcaggaagtccttctggatctgcgtgaacggtgtgaacgacgccagctcgatgacgccgagcacattcccctcgaagagcaccggaagcacgatgacctgtgcgggcggcgcctcgccgagccccgaggagatcttcaggtacccgctcggcgcgttctccacgaggatcgtgcgcttctcctgggcggccgtcccgatgagcgcctcaccgggccggaacgacgtcggcatggagcccatcgagtagccgtaggacccgcacatccgcagctcgtacgcgtcctcctgctcggcgccgccctccctggcgtcgaccagcggcatggccaggaagaacgctccgtgctgcgcggacacgaccggcgtcagctcgctcatgatcagcgaggccacgtcgtcgaggtcgcggcgcccctgcatcagggcggagatccgggcgagattgcccttgagccagtcctgttccttgttggcgatggtggtgtcgcgcaggttggcgatcatcttgttgatgtagtcctgaagttcctggatctcgcccgaggcgtccacgtcgatcttcaggttcaggtcgccgcgggtcaccgcggtcgccacgcgcgcgatggcgcgcacctgccgggtcaggttcccggccatctcgttcaccgactcggtgaggtcgcgccaggtgccgtcgacgtcccgcacgcgtgcctggccgcccagctgcccctcggtgcccacctcgcgggcgactcgggtgacctcttcagcgaaggacgacagctggtccaccatcgtgttgatggtggtcttcagctccaggatctcgccgcgggcatcgatgtcgatcttcttggtcaggtcgcccttggcgatggcggtggtgaccatcgcgatgttccgcacctggccggtcaggttggacgccatgccgttcacggactcggtgaggtccttccacgtaccggcgacccccgggacgtgcgcctgcccgccgaggatgccgtccgtgcccacctcgcgggccaccttggtgacctggtcggcgaacgaactcagcgtcttcaccatggtgttgaaggtgtcggcgagctgcgcgacctcgccgcgcgcctcgatcgtcaccgtccgggtcaggtcgccgttggcgacggccgcggcgacctgcgagatgttgcgcacctgcatggtcaggttgttggccatcaggttgacgttgttactgaggtccttccagatgcccgtgacaccgggcacgtgcgcctgaccgccgaggatgccctcggtgcccacctcgcgggccacccgggtcacctgctcggcgaaggacgacagctggtccaccatcgtgttgacggtggtgacgagttcgaggatctcgcccttcgcgtcgacagtgatcttcttcgacaggtcacccttggcgaccgcggtcgtgacctcggcgatgttgcgcacctgaatggtcaggttgttcgccatgaagttcacggactgggtgaggtccttccaggtgccggagacaccctgcacctcggcctgtccgccgagcatgccctccgtgccgacctcgcgggccacccgggtcacctgctcggcgaagttcgagagctggtccaccatcgtgttgagggtgttcttcagctccaggatctcgccgcgcgcgtccacgtcgatcttctgcgacaggtcaccccgcgccaccgcggtcgcgacctgcgcgatgttgcgcacctgggcggtgaggttgcccgccatgccgttcacggaatccgtcaggtcgcgccacaccccggcgacgcccggcacctgcgcctgaccgccgagccggccttccgtgcccacctcgcgggcgacccgggtcacctggtcggcgaaggcggagagctggtcgaccatcgtgttgatggtgttcttcagctccaggatctcgccgcgcgcgtccacgtcgatcttctgcgacaggtcaccccgcgccaccgccgtcgtgacctgggcgatctgccgcacctgcgaggtcaggttccccgccatgaaattgacggagtcggtgagttccttccacgtaccggacacgccgtccacccgggcctgaccgccgaggcggccctccgtacccacgtcccgggccatccgcgtcacctggtcggcgaaggacgacagctggtcgaccatcgtgttgacggtgttcttcagctggagcatctcgccggagacgtcgaccgtgaccttctgcgagaggtcaccgttggcgacagccgtcgtcacctgggcgatgttccgcacctggcccgtcaggttccggaacgccgtgttgacggagtccgtcaggtccttccacgtaccggccgcccccggcacctgcgcctgaccgcccagctccccctcgacgccgacctcgcgcgccacgcgcgtgacctcggcgccgaacgacgacagctggtcgaccatcgtgttgacggtgttcttcagctccagcatctcgccggccacgtcgaccgtgaccttctgcgacaggtcaccgttggccacggccgtcgtcacggcggcgatgtcccgcacctgagtggtcaggttccggaagaccgtgttcaccgaatcggtgaggtccttccacgtacccgccgcacccggcacgttcgcctgcccgccgagccgcccctccccgccgacctcgttggccacgcgggtgacctcgtccgcgaatgtgcgcagcgtctcagtcatctggttgatcgtctcggcgagctgcgcgacctccccgcgcgccgacacggtcaccttctgcgacaggtcaccgttggcgaccgcggtcgtcacctgcgcgatcccgcgcacctgggccgtcaggttgccggccatgaggttcaccgaatcggtgaggtccttccacacgccggccacaccgggcacctgcgcctgaccgcccaactcaccctcggtacccacctcacgtgcgactcgcgtcacctcggaggagaacgaggacagctggtccaccatcgtgttgacggtgttcttgagctccagcatctcgccggccacgtgaaccgtgaccttccgggacagatcacccttcgcgaccgccgtcgtcacgagagcgatgtcacgcacctgagcggtcagccggtacgccatggtgttgacggagtccgtgagatccttccacgaaccggacataccgcgcacccgggcctgcccgcccagcttgccctcggtgcccacctcgctggccacgcgggtgacctcgtcggtgaacgacgacagctgatcgaccaggttgttgaccgtgcgcccgaccttcaggaactcaccgcgcagcggatgcccgttcccgtccgccgcctgcgcccgcagctccatccgcggcgacaggtcgccctcggccaccgcggacagcacccggctgacctcggagacgggccgcgcgaggtcgtcgacgagcgcgttggagttgtcgatcgcggccgcccacgaaccctcgcaggcacccgactccagccgttccgtgagctttccctcacggccgaccatgcgccgcacccgcgccagctcaccggtcagatgcaggttgcgctcggccacttcattgaaaaccgccgcaatctcggacatcacgccgtcgcccgagactgtcaaccgtttgcggaagttgccgtcccgcatcgacaccagggcagccagcagccggttcagggctgccgtatccaccgccgtggtgccggtgcgcggtttgcgctggttactcagggactgtccgcctttcgcgcgcgtcttagtgccccgcgtcgctgcgccagactccactgtgtccctcccgcagggtcgaccaatactgctgtgcgtgctcggcttgctgatacttctgatgatgcttctgcgcttctgctcggcctgccgcgtcctagtactcggcgcgccaggtgctgccgccggtcgtacacggcagacgcgcggcctgccccggccttcctacgaagcctgcccagtgtttcaccctggttgaaccaggccataacagttcggcagcttcgcacacggtccgcacaccctccggaacgaaacagtggtgaccggcatccgcacggacggcgaaggtaagtaaccttgcatgcggctgtccagccgtgccggtccgtccggcctgggcggtggcacgagcacgagcgggcaggcatcggaggggcaccgcaccatgaccaccggactgcatcccgggggaccaccccaggatccccggccgacggggaaccagccgctgccgaggcaggagcgggtcggcgaggcagccctgcacgccgacaaccggacgaggagttctgtgatcaccgcgcgcgcggccgccagtttcgatcctgtcgggcgatcggtcgcgaccgcccgctccttcgtccgcgacaccctccagggctggggtttcgccgacatcgtcgacgacgccgtggtcctcaccagcgagctggtcaccaacgccgtggtgcacgcgggtacgtccgcggacgtgctctgtctgcgcagcgacgacggcgtacgcatcgaggtcggggacagatatcccgaacgcgagatccccctccaggccgccgccgtcaacatgggcaaccccgaccgcgaggggggccgcggcctccagctctgcgctgccctggccggccgctggggcgtcgactacacacccacgcacaaacaggtctggttccaactggacctccccgaacgcccggtgggcacccgcaccgccggcccgtccctccccgccgagctcctcccgctcgccgacggccgggtccgtgtcgccgtcgtccagatcgaccgagcgggcgccatcaacgcgtggaacgaggacgcggaggagctcttcgggtacgcggccgagctggtcatcggcaagcccctcaccgaccttgcggcctggccccacaccccgggcaccagcaccggcatcgtcgaggccctccagctgtcgcgctgggagggcagttacggcgtccgcggcgcgagcggccgcgtgatccccgtgtacgcctcccacctccgggtgcgggacaccggcggcgaaccgtccacggtctgcctcctggtacgcgaacacgaacgcgccgtcctccagaccccgttgcgcggacagtcccccgacgcgacgaacagcgccgagggccaggccctggacccgttcgaggtcttcatcggctccccggcccccgacgacctcgacggcctgctccagcgcacggtggagcgcgcccgcgacatgctcgacgccgactcggcgttcctgctcctggccaccgacgacgagacggagctggaggtacgagcctcgacgggcctcccctcggcccgccagcgcttcgcccgtgtcccggtcgacgcgggccccggccgctacgggtcggcccgcatgccggccgtccatgacgacctcaccgccgtccccggcgcggtccccctgctcagcggcacgggcatgcgttcggtcgtcacggtcccgctgaaggtcgagggccgcctcaccggttcgctcggcgtcgcggccgagtccccgtcccggtactccaacgaggaggccctgcgcctccagttcgccgccgaccgcatcgcgctcgctgtggagtccgcccggctcggcgagctggagcgcctgcgccgcggttccctgagcttcctggtggaggcctcggacctcctggcgggcaccctggaccgcgaccagaccctggctctgatggcccagatgaccatcccgaccctcgccacctggtgcgccgtctacacgatcgccgaccaggcctcggagccgtacctctcctacgttctccacgaggacgaggaccgcatcgacggcgtcaaggcactcctgtcgaagatccccccgccggagccgattccgacgccgggcgcccgcgtctggtcggccccggcacaggcggctcacgaggcggccctgcggacgtccatgcgcagcctgggcctgggcgagcccgcgacggtgagctccggcatcggtacgaccctggcgacggcgtccgcggtgggcggcgagacggtcgtcctccccctggtggcgcgcaaccgcgtcatcggcatgctgacgctgggcaagccgtcggacgaacacttccgccaggagatcctggagctggccgaggacttgagccgccgggccgccctggccctggacaacgctcgcctgtactcggagcgcacggccatcagccagtccctccagcgcagcctcctgccgccggatctcccgcacatcgagggcgtcgaggtcgaggtcatctaccgcgcggccggcgagggcaacgaggtcggcggcgacttctacgacctcttcccgatccgcgacggtgcgtacggcttcgccatcggcgacgtctgcggtacgggcccgaacgcggcggcggtcaccggcctggcccggcacgccctgcgtctcctggcccgcgagggcctcagcggcccggcggtgctggagcgcctcaactccgcgatcctcgacgagggcgcccgcagccgcttcctgacgctcctgtacggggagttgtggcctcaggaggacggcagcgccctcctcaaggtggtctgcgccggccacccgctcccgctccgcctgcgccaggacggcacggtcgaaccggccgccgaaccgcagccgctcctcggcgtcatggaggacctggagctgtacgagcagacggtgacgctcgatccgggtgacgtcctgctgtgcgtcacggacggagtcaccgaacgccgcgagggcacccgcatgttgggcgacgacggactgacggacgtcctcaccacgtgcacgggcctgacagcgggcgcggtggcggcccgcatcatgcgtgcggtcgaacgcttcgcctcggacgccccgtcggacgacatggccattctcgcgatgcgtgtggcgggcctgcagaaggactgaaggcccgccccagggcacgaaaaaggccccgcccggaagggcgaggccttttctgctgtggagcccccaaacggaatcgaaccgttgaccttctccttaccatggagacgctctgccgactgagctatgggggccagtcgccttctcgaggtttccctcgcggcaacggaatagatcataccccgaacagaagcgtgctcccaacacacctgttgggtcagaaggcaggctgaaggagtccgccgagcgcattgcacgcggagacgatccgctgcatctcgcgctttgtcagcgacacgtccacgggcagcgccaatgtctcgtccgcggcccgctcggtctccggcaggcacacgtcccgacggaaggcgggcatgcggtgtacgggcgtcttcaccggcacccggcagtcaactcccttggaccgcacggcccgcgcgaatgcgtcgcggtccgggcgcccgttcccgggcacgcgcacgacgtaatgctgataggtgtgcccgtcaccgccgtccggcgtccacaccccgttcaaccgggcatcgagataggcggcccgctccctgcgctgcgcgatctcgtcgtacggcgcctcggactcgccctgctcgagcacgagaaggccgtgccgctgtccgacaccgtgcagccgagcgatgtcggccggccggccgaagcggtgtacggcgatgacggccacggtccccgaggtcacggcggcctcgaccgccgcggggtccaggcagtacgtggccgggtctatgtccgcgaagacgggcgtcgcaccggccagggtcacggcctcggcgacttcgacgttcccgaaggccgggacgatgacctcgtcaccggctcctgcgccggcggccttgagcattccaacggtacccatgatgcggatgctcgccgcgcaacgtgaactgcaagtgacacacaacaaaaaagagctggtccctgaaccgaagttcagggaccagctcttctaaaatttgttcggcggcgtcctactctcccacagggtcccccctgcagtaccatcggcgctgtaaggcttagcttccgggttcggaatgtaaccgggcgtttccctcacgctatgaccaccgaaacactatgaaactgtcaaccgcaccatcccgtgaccatggaatggggttgttcgtggtttcagaaccaacacagtggacgcgagcaactgaggacaagccctcggcctattagtaccagtcacctccagcggttacccgccttccagatctggcctatcaacccagtcgtctactgggagccttaccctctcaaggaggtgggaatactcatctcgaagcaggcttcccgcttagatgctttcagcggttatccctcccgaacgtagccaaccagccatgcccttggcaggacaactggcacaccagaggttcgtccgtcccggtcctctcgtactagggacagcccttctcaatattcctgcgcgcgcagcggatagggaccgaactgtctcacgacgttctaaacccagctcgcgtaccgctttaatgggcgaacagcccaacccttgggaccgactccagccccaggatgcgacgagccgacatcgaggtgccaaaccatcccgtcgatatggactcttggggaagatcagcctgttatccccggggtaccttttatccgttgagcgacggcgcttccacaagccaccgccggatcactagtcccgactttcgtccctgctcgacccgtcggtctcacagtcaagctcccttgtgcacttacactcaacacctgattgccaaccaggctgagggaacctttgggcgcctccgttactctttaggaggcaaccgccccagttaaactacccatcagacactgtccctgatccggatcacggacccaggttagacatccagcacgaccagactggtatttcaacgacgactccacccacactggcgtgcgggcttcaaagtctcccagctatcctacacaagccgaaccgaacaccaatatcaaactgtagtaaaggtcccggggtctttccgtcctgctgcgcgaaacgagcatctttactcgtagtgcaatttcaccgggcctatggttgagacagtcgagaagtcgttacgccattcgtgcaggtcggaacttacccgacaaggaatttcgctaccttaggatggttatagttaccaccgccgtttactggcgcttaagttctcagcttcgccaaaccgaagtttgactaaccggtccccttaacgttccagcaccgggcaggcgtcagtccgtatacatcgccttacggcttcgcacggacctgtgtttttagtaaacagtcgcttctcgctggtctctgcggccacccccagctcaccaagtaaattggatcaccagtgatggccccccttctcccgaagttacgggggcattttgccgagttccttaaccatagttcacccgaacgcctcggtattctctacctgaccacctgagtcggtttagggtacgggccgccatgaaactcgctagaggcttttctcgacagcataggatcatccacttcaccacaatcggctcggcatcaggtctcagccttaatgcgcgacggatttacctatcgcacggcctacacccttaccccgggacaaccaccgcccgggatggactaccttcctgcgtcaccccatcactcacctactaccaccttgggtcagcggctccaccactcccctttgcccgaaggctccagggcggcttcacggccttagcattaatgggctcgatgtttgacgcttcacagcgggtaccggaatatcaaccggttatccatcgactacgcctgtcggcctcgccttaggtcccgacttaccctgggcagatcagcttgacccaggaacccttagtcaatcggcgcacacgtttctcacgtgtgtatcgctactcatgcctgcattctcactcgtgaaccgtccaccactgccttccggcgcggcttcacccggcacacgacgctcccctacccatcacagcacccgttggggctatacgctgcaatgacacgacttcggcggtacgcttgagccccgctacattgtcggcgcggaatcactagaccagtgagctattacgcactctttcaagggtggctgcttctaagccaacctcctggttgtctgtgcgactccacatcctttcccacttagcgtacgcttaggggccttagtcgatgctctgggctgtttccctctcgaccatggagcttatcccccacagtctcactgccgcgctctcacttaccggcattcggagtttggctaaggtcagtaacccggtagggcccatcgcctatccagtgctctacctccggcaagaaacacacgacgctgcacctaaatgcatttcggggagaaccagctatcacggagtttgattggcctttcacccctaaccacaggtcatcccccaggttttcaaccctggtgggttcggtcctccacgaagtcttacctccgcttcaacctgcccatggctagatcactccgcttcgggtcttgagcgcgctactaaatcgccctattcggactcgctttcgctacggcttccccacacgggttaacctcgcaacacaccgcaaactcgcaggctcattcttcaaaaggcacgcagtcacgacgcaccgagtaaactcgatgcgcgacgctcccacggcttgtaggcacacggtttcaggtactatttcactccgctcccgcggtacttttcaccattccctcacggtactatccgctatcggtcaccagggaatatttaggcttagcgggtggtcccgccagattcacacgggatttctcgggccccgtgctacttgggtgtctctcaaacgagccgctgatgtttcgactacgggggtcttaccctctacgccggacctttcgcatgtccttcgcctacatcaacggtttctgactcgtctcacggccggcagaccgtaaaagagagatcccacaaccccgtatacgcaacccctgccgggtctcacacgcatacggtttggcctcatccagtttcgctcgccactactcccggaatcacggttgttttctcttcctgcgggtactgagatgtttcacttccccgcgttccctccacataccctatgtgttcaggtatgggtgacagcccatgacgactgccgggtttccccattcggaaacccccggatcaaagcctggttgacggctccccggggactatcgtggcctcccacgtccttcatcggttcctggtgccaaggcatccaccgtgcgcccttaaaaacttggccacagatgctcgcgtccactgtgcagttctcaaacaacgaccaaccacccgtcacaacccgccgaagcagatctttaccggggccggcactgaaggcagccatgatcggccgtaccctcagacacccaacagcgtgcccgacaccctcgccctcccatgttcgctttccacgccgaagcagtacttgccaacctgagcaggtcgagtgtgccgaataatcaacgttccacccttgagcaaccagcatcagacagtcgctgatgtactggcctctgacctcaccccgaagggatcggtaagaagtgctccttagaaaggaggtgatccagccgcaccttccggtacggctaccttgttacgacttcgtcccaatcgccagtcccaccttcgacagctccctcccacaaggggttgggccaccggcttcgggtgttaccgactttcgtgacgtgacgggcggtgtgtacaaggcccgggaacgtattcaccgcagcaatgctgatctgcgattactagcaactccaacttcatggggtcgagttgcagaccccaatccgaactgagaccgactttttgagattcgctccaccttgcggtatcgcagctcattgtatcggccattgtagcacgtgtgcagcccaagacataaggggcatgatgacttgacgtcgtccccaccttcctccgagttgaccccggcggtctcctgtgagtccccatcaccccgaagggcatgctggcaacacagaacaagggttgcgctcgttgcgggacttaacccaacatctcacgacacgagctgacgacagccatgcaccacctgtacaccgaccacaaggggggcactatctctaatgctttccggtgtatgtcaagccttggtaaggttcttcgcgttgcgtcgaattaagccacatgctccgctgcttgtgcgggcccccgtcaattcctttgagttttagccttgcggccgtactccccaggcggggaacttaatgcgttagctgcggcaccgacgacgtggaatgtcgccaacacctagttcccaccgtttacggcgtggactaccagggtatctaatcctgttcgctccccacgctttcgctcctcagcgtcagtaatggcccagagatccgccttcgccaccggtgttcctcctgatatctgcgcatttcaccgctacaccaggaattccgatctcccctaccacactctagctagcccgtatcgaatgcagacccggggttaagccccgggctttcacacccgacgtgacaagccgcctacgagctctttacgcccaataattccggacaacgcttgcgccctacgtattaccgcggctgctggcacgtagttagccggcgcttcttctgcaggtaccgtcactttcgcttcttccctgctgaaagaggtttacaacccgaaggccgtcatccctcacgcggcgtcgctgcatcaggctttcgcccattgtgcaatattccccactgctgcctcccgtaggagtctgggccgtgtctcagtcccagtgtggccggtcgccctctcaggccggctacccgtcgtcgccttggtgagccactacctcaccaacaagctgataggccgcgggctcatcctgcaccgccggagcttttaaccctcacagatgcctgcgagagtattatccggtattagaccccgtttccagggcttgtcccagagtgcagggcagattgcccacgtgttactcacccgttcgccactaatccaccccgaagggcttcatcgttcgacttgcatgtgttaagcacgccgccagcgttcgtcctgagccaggatcaaactctccgtgaatgttttcccgtaatcgggacgacaccacgagagcggaacagccgggcggaataagcccagccgttcacagcgtcctcgctgtgcgcctaccgaacaacgtcggcaggactttttcaaaggaacctcgtcccagccgatcggccggagacggggtatcaacatatctggcgttgatttttggcacgctgttgagttctcaaggaacggacgcttcctttgtactcacccgagagactctctcaggctttcctccgggcgcttcccttcggtcttgcgtttccgactctatcagaccgttttccgatccgatttcctcggcgctttccaggtttccgctttcgcgtttccctttccggcggttccgattctatcagactgttttccggtctgatttcctcggtgctttccaggttctcgctttcgcgattccctttccggcggctccgactttatcagaggttctgagtcggattttccgtcccgctcggggttcctgacgcacagtcgcatcgggttccccctcgggcggagccgtaaacgtactggagcggggcgccccgatgcaaatcgaggagccccgctccgggttcacgcgtacgagcggtcgtacgagggtcagacctcgaccacgaccggcaggatcatcggccggcgccggtaggtgtccgagacccacttgcccagtgtgcggcggatgagttgctgcagctggtggggctccatgaccccgtcctgagcggacctctccagcacttcggcgatcttcgggatgacgtcgccgaacgcggagtcgtcgatgccggagccacgggcctggatgtggggaccaccagtgatctttccggtggacgcgtccacgaccaggaagaccgagatgatcccctcgtcgccgaggatcttgcggtccttgagcgcgggctcgccgacgtcgccgaccgagaggccgtcgacgtacacgtatcccgcctggaccttgccggtgatcttggccttgccctcgaccaggtcgacgacgacgccgtcctcggcgatcacgatgcggtcgtgcgggacgccggtgagagcgcccagctcggcgttggcccgcagatggcgccattcgccgtggaccggcatgaggttgcgtggcttgcagatgttgtagaagtacaacagctcgccggccgaggcgtggcccgagacgtgcaccttggcgttgcccttgtggacgacgtgcgcgccccagcgggtcaggccgttgatcacgcggtagaccgcgttctcgttaccggggatgagcgacgacgcgaggatgaccgtgtcgccctggacgatgcggatctgatggtcccggttggccatgcgtgacagagccgccatcggctcgccctgcgagcccgtgcagaccagcacgatctcgtgctccgggaggtcgtccagcgtcttgacgtccacgaccaggcccggcggaaccttcagatagcccaggtcccgggcgatgcccatgttgcggaccatcgagcgtccgacgaaggcgacccggcggccgtactcgtgcgccgcgtccaggatctgctggatgcggtggacgtggctggcgaagctcgccacgatgatccgcttgcgggcgcccgcgaagacgttgcgcagcacgttcgagatgtcgcgctcgggcgggacgaaacccgggacctccgcgttcgtcgagtccgagaggaggaggtcgatgccctcctcactcagccgcgcgaacgcgtggaggtccgtcagacggttgtccagcgggagctggtccatcttgaagtcgcccgtgtggacgaccatgccggccggagtgcggatggcgaccgccaaggcgtccggaatggagtggttgacggcgacgaactcgcagtcgaacgggccgatgcgctcgcggttcccctccgccacctcaagggtgtacggacggatgcggtgctcctggagcttcgcctcgatgagtgcgagggtcagcttggagccgatcagcgggatgtccggcttctcccggaggaggaacgggacgccgccgatgtggtcctcgtggccatgggtgaggacgatgccctcgatgtcgtcgaggcggtccctgatggacgtgaagtccggcaggatcaggtcgattccgggctgctcctcctcggggaagagcactccgcagtcgacgatcagcaggcgaccgccgtactcgaagacggtcatgttgcggccgatttcgccgagaccgcccagcggggtgacccgaaggccgcccttggggagcttcggcggcgggccgagttcaggatgcggatgactcaaaagactctcctcaccatgcgcgccacgtaccggtaaggcacgtggcgcgcatgacgttcgtgcaaaagcagttgttggtgtggggtgcaggcacgtgagccctgcgtattcagttgtgaagtctggtgttagagctgtaccccgccggcggcaagatcgatcttgagctgagcggtctcctcgggcgagagctcgaccatgggggcgcgcagcggtccggcgggcaggccctggagggcgagggcggccttggtggtcatgacgccctgggtgcggaacataccggtgaacaccggcagcagcttctggtggatctccagcgccttctggacgtccccgccgatgtacgcctccgccatcgcgcgcagctcgggcgtgaccacgtggccgaccaccgagacgaagccgacggcacccacggacagcagcgggaggttcagcatgtcgtcgccggagtaccaggccagacccgagcgggcgatcgcccagctcgcgcggcccaggtcgcccttggcgtccttgttggcgacgatccgcgggtgctcggcgagccggaccatcgtctcggtgctgatcggtacgccgctgcggccggggatgtcgtagagcatcaccggcagctcggtcgcgtcggcgatcgccgtgaagtgccggtacaggccctcctgcgggggcttgttgtagtacggcgtgacggtcagcaggccgtgcgcgccggccttctctgccgcgcgcgccagctcgatgctgtggtgcgtgtcgttcgtgccgacgccggcgacgatgtgggctcggtcgccgaccgcctccaggacggctcgtacgagatccgatttctccgcgttgctggtggtcggggactcgccggtggtgccgttgatgatcaggccgtcgttgcctgcgtccaccaggtgggcagcgagccgctgcgcgccgtcgaggtcgagtgcgccgtccgccgcgaagggcgtgaccatggcggtgaggacccgcccgaagggggtctgcggagtggaggtcggagccatgggtaacacgctactcgctgctcaacatggggtctgccctcgggggacgcgacaagtcgtgacaaatgcggagcccggcactgcctgctcgggggttcaagcagtgccgggtccgtttgatcaggctagatgaacttcccgaaatgccgcaatacggacacttcgccgggctggccgcacatctgtgcccgacacggggactgaggcgcgtgcagagcggtctgggtgcgttacggcgccacgcgcccgttcgtgttgaaggccgcgtacgtcagcggcatgagcttggcccactccgcctccatcttctcgccgaccatctcgatctcccgctgcgggaaggacggcaccttggccagctcgtgctgggtgcgcaggccgaggaagtgcatcagcgagcgggcgttgcacgtggcgtacatcgaggagaagaggccgacggggaggaccgcgcgggcgacctcgcgggcgacgccggcggcgagcatctcctggtaggcctcgtacgcctgacggtacgagtcctccatgacgcggcccgtgagctcctgctgtgcctgggtgccctcgacgaagacgtacttgccggggcggccctcctggaccagcttgcgggactcccccgggacgtagaagaccggctcgagctccctgtaccggcccgactcctcgttgtacgaccagcccacccggtgtcgcatgaactcgcggaacacgaagatgggggcgctgatgaagaacgtcatcgagttgtgctcgaaggggctgccgtgccggtcccgcatcaggtagttgatcaggcccttcgagcgctccgggtccttcttcagctcgtccagggactgctcgccggcggtggagacgcgggcggcccacagcacgtccgagtcggccgcgctgtgcttcaccaactcgacggtgacgtcgctgcggaagctgggcttgaggtcgtcggcgggggtgtcggtcacggcttggagggtccttcccatcacatctctcgggcggcgcccactctacggcccggcactgacaacggggcgttcggtgccgtgccgcgacattcctcgccgaacttctgcgaattcggcgaaactgggcacctcttggggcgttcgttcgtctgtatgggtgacagtgatccgttcgagcctccagaggagaagcacaccccatgttccgtcggcgcgagcccgttccgttcgccttcatcgccgaagccgacaagttccgcagcaatgtcaccccgccgccccgccagcgggcgtccgccggtcagacggccgggcgctggctcctgggactcaccgtgatcgccgggctcgtgggcgcgctggtcgtcgggatgccttcgctgtcactcgaccagtcacctgcgacgacgcagcattccgaggcgtcccgggggcactgacgcccgtccaccgcccgagtggcgcggggaggcacccccatggccccccaagggtggtgagcaaggacacggctcgataacctcaccgggcacagcccatgaatggaattgagtgaggatgagtcgtgcccctgcccttcctgacggccgaccgcacgtttgacgaggcggcggacgacctcccgctgccctacgacgaccgcgaccgctggcggcgcccgtaccggccaggtccctggcgggtgggcatggccgcacttctgctcctgctcgcgtcgtacgtgctcgccgcggcggtcgtcatcgcgctcaccggcaccgcctcaggcgccggagcggtcctggggatcgcggccgtcgtgatcgcctgcgcgctgcggatgctgcgcatgggcgtctgggtgagcgcgcgcggagtgcgccgggtcggcttcctgcgtacgggcaccacgccgtgggagcaggtcgtcgcggtgcgcacggttcagcagccggtgcgctggctcgggctgccgcgcacggttcaggggcaggcgctgatcctcgtacgtggggatcgtgcccccgaggaccagccgtcgctgctgaccacgcacggcgccgacttcctggcgcgtgcggcggccttcgaccgggcggccgacgcggtcgaggcctgggcgtcggagtacgggcggagctgagccgaggcgaacgtgtgtttgaggggccggtccgcactcgcgggccggcccccgacgcgttccggggtcgaaagggctcaggcctcgaccggccttccctcgtggagcgcgatggcgcgctgcatcgccttgcgggcccgcggggtgtcgcgggcgtcgtggtaggcgacggcgagacggaaccagctgcgccagtcgcccggggcgtcctcggtctcggccttgcggcgggcgaagacctcgtcggccgagtcccggtcgatgcggccgcccggcgtgcgcctcagctcgtcgacgggcaggccgccctcggcgtcgagctcggcggcgagcgcgttggccttccggacgaactgcgtgttcttccagaggaaccagacaccgatgaccggcaggatcagcaccgcgacaccgaaggtgacggtgaccagggtgccgttctggatcaggagcacaccgcggctgccgaccaggacgaagtagacgaccaggacggcggccgtgacggcgtacgtgattttggcgcgcatgtccgtcagttcaggtccaggaagtgctccaggccgaacgtgaggccgggagtggtgacgacacggcgggcgccgagcaggatgcccggcatgaagctgctgtggtgcagcgagtcgtggcggacggtgagggtctcgccctcggcgccgagcagcacttcctggtgcgcgagcaggccgcgcaggcggaccgcgtgcaccgggacaccgtcgacgttcgcaccgcgggcaccgtccagggccgtcaccgtggcgtcgggctgcggagcgctgcccgccttgcggcgggcctcggcgatgagctgggcggtgcgcgtggccgtgccgctgggggcgtccaccttgttcgggtggtgcagctcgacgacctcgacggactcgaagtacggcgccgcgagctgcgcaaacttcatggtcagcacggccccgatggagaagttgggcgcgatgagcacacccgtctccggcgactgggccagccagcccttcagctgcgcgaggcggtcgtcggtccagcccgtcgtaccgaccacggcgtggatgccgtggcgtacgcagaagtcgaggttgcccatcaccgaggccggcgtggtcagttcgacggcgacctgggcgccggtgtcggccagcgtctccagtttgtcgcctcggccgagggcggccaccagttccatgtcctcggctgcctcgacggctcgtaccgcctcggatccgatgcggcccttgacaccgaggaccgccacgcgcaacttgctcatgttcttgattccttagtcgaggacttacgcgaccgcttcgtgcagacgggacgcctgcttgtccttgagcgggccgatgaccgacagcgagggccgctgtcccaggatgtcgcgggcgaccgaacggacatcgtccggggtgacctcggtgatccgggccagcatgtcgtcgacggacatctgctcgccccagcacagctcactcttgccgatacggttcatcaacgcaccggtgtcctccaggccgaggaccgtggagcccttgagctggccgatggcgcgggcgatctcgtcgtcggacaggccgtgctcggcgacgtggtcgagttcgtcccggcagatcttcagcacgtcgtggacctggctcgggcggcagcccgcgtacacgccgaacaggccgcagtcggcgaaacccgaggtgtacgagtacacgctgtaggccaggccgcgcttctcgcggacctcctggaacaggcgcgaggacatgccgccgccgagcgccgtgttcagtacgccaagggcccagcggcgctcgtcggtgcgggcgagacccggcatgccgaggacgacatgggcctgctcggtcttgcggccgagcagctcgacgcggcccgcggtgcggatggcgcggcggccgtcgcgcggggcgatcggggtggcgtccggctgcttcagggcgcccgccttctcgaaggcggcgcggacctgtcgtacgaccttgttgtggtcgacgttgcccgcgcacgcgaccacgaggtgggtcgggtcgtagtgcttcttgtagaagcggcggatgcggtccgcggtgagggcgttgaccgtgtcgaccgtgccgaggaccgggcggccgagcggggtgtcgccgagcatcgtgtgcgcgaacaggtcgtgcacacagtcgcccgggtcgtcctcggtcatcgcgatctcttcgaggatcgcgccgcgctcgacgttgacgtcctcttcgaggatgagcgagccggtcagcatgtcgcagaccacgtcgatggcgagcggcagatcggtgtcgagcacgcgcgcgtagtagcacgtgtactccttcgccgtgaacgcgttcatctcgccgccgaccgcgtcgagggccgacgagatgtccagggcgctgcgcttgtgcgtgcctttgaagagcaggtgctccaggtagtgcgtcgcgccgttcagcgtgggcgtctcgtcgcgggaaccgacgtgggcccagatcccgaaggtcgccgagcgtaccgagggcagcgtctcggtgacgatgcgcaggccgcccgggagggtggtcttgcggaccgtaccgatgccgttgacgcccttgacgagggtttgggtacgggcgacggcccgcgcctccgaggaggtgcgggccgtcgccgtggagctacgagacgtcacttgtcggtgtcgtccttcttctcgtcgtcgccttcgccctcgaccacggggatgagggagagcttgccgcgggagtcgatctcggcgatctcgacctggaccttggcgcccacaccgagcacgtcctcgacgttctccacgcgcttgccgccggcgagcttgcggatctgcgagatgtgcagcagaccgtccttgcccgggagcagcgacacgaacgcaccgaaggtggtcgtcttgacgaccgtgcccaggtagcgctcgccgacctccggcatggtcgggttggcgatgccgttgatcgtggcgcgggcggcctcggcctgcgagccgacctgggcaccgatgtagatggtgccgtcgtcctcgatcgtgatctcggcgccggtgtcctcctggatctggttgatcatcttgcccttggggccgatgacctcaccgatcttgtccacggggatcttgacggtgatgatccgcggggcgttcggggacatctcgtccggcgtgtcgatcgcttccatcatcacgtcgaggatgtggaggcgggcgtcgcgggcctgcttgagggccgcggccaggacggaggccgggatgccgtccagcttggtgtcgagctggagggcggtcacgaactccttggtgccggcgaccttgaagtccatgtcgccgaaggcgtcctccgcaccgaggatgtcggtgagggcgacgtagtgcgtctcgccgttgatctcctgggagatcaggcccatggcgataccggcgacgggggccttcagcggcacaccggcgttcagcagcgacatggtggaggcgcagaccgagcccatggacgtcgatccgttggagccgagggcctcggacacctgacggatcgcgtacgggaactcctcgcgcgtcggcaggaccggcacgatcgcgcgctcggcgagcgcgccgtggccgatctcgcggcgcttcggggagccgacgcggccggtctcgccgacggagtacggcgggaagttgtagttgtgcatgtagcgcttgcgggtcaccggggagagggtgtccagctgctgctccatacggagcatgttcagggtggtgacgcccaggatctgggtctcaccacgctcgaacagcgccgagccgtgcacacgcgggatggcctcgacctcggcggcgagcgtacggatgtccgtgacgcctcggccgtcgatgcggaccttgtccttgatgacgcgctcgcgcaccagggacttggtcagcgagcggtacgcggcggagatctccttctcgcgaccctcgaactgcgggagcagcttctcggcggcgatctccttgacgcggtccagctcggcctcgcggtcctgctttccggcgatggtgagcgcctgggagagctcgctcttgaccgcggcggtcagggcctccaggacgtcgtcctggtagtcgaggaagaccgggaactcgccggtcggcttggcggccttcgcggcgaggtcggcctgagccttgcagagcaccttgatgaagggcttcgcggcgtccagaccggcggcgacgacctcctcggtcggcgcctcggcgccgcccgcgaccaactggatggtcttctcggtggcctcggcctcgaccatcatgatcgcgacgtcgccgtcctccagggcgcggcccgcgacgaccatgtcgaagacggcgtcctcgagctcggtgtgcgtcgggaacgcgacccactggccgttgatcagcgcgacgcggacgccgccgatcgggccggagaagggcaggccggccagctgcgtggacgcggacgcggcgttgatcgcgacgacgtcgtacaggtggtcggggttgagcgccatgatcgtcgcgacgacctggatctcgttgcgcaggcccttcttgaaggacgggcgcagcgggcggtcgatcaggcgacaggtgaggatcgcgtcctcggagggacggccctcgcggcggaagaagctgccggggatcttgccggcggcgtacatccgctcctcgacgtccaccgtgagggggaagaagtcgagattttccttgggcttcttggaggcggtggtggccgacagcaccatggtgtcgtcgtccaggtacgcgacggcggagccggcggcctgcttggccaggcggcccgtctcgaagcggatggtgcgggtgccgaaggaaccgttgtcaatgacggcctcggcgtagtgggtctcgttctccactagcgttttctccgatacttttcgtcttttgtcccgggctgcccgtgtggcagggggacggtggtcggagaagcgctccactggtgcgggccggtcttcgatcgaagcacccggggctcacttcccccgggggccactaccgaggaccggcggcggcgaggtgcgcttctcctcgttgggtgtggcgtgccgtcatcgctgtgcgctgtcggtgtaccacgttgtgtgtcgtacgtattgcgttgtgctaccacactacaaaggggcagcgacactccgcacgtttccgtacgtacagcaaagggagcggccccctaagtcatgggaaccgctcccttcacggcgtcttacttggcgcccgccgcaccgcggcggatgcccaggcggtcgaccagcgcacggaagcgctggatgtccttcttggccaggtactgcagcaggcggcgacgctgaccgaccaggatcagcagaccacgacgggagtggtggtcgtgcttgtgggtcttgaggtgctcggtcaggtccgagatccggcgcgagagcatggcgacctggacctcgggggagccggtgtcgccctccttggtaccgaactcggtgatgatctgcttcttcgtagcggcgtcgagcgacacgcgtactcctcgtagtctgaaagaggccaccgagtgcccccggtcttggtctcgggggagcttccgttactcgggaggcggggatccgctgggcgcggcctccagatccctgggcgatccttgcggcgcctggggcggggtccgggggtgcgtacacgaacggccgttacacagggtaccaggctgtacggaggcgctcggccgaggtcctggggcggtcagccgctggtctcgaacccgtcggcgagccattcgctctccccttcgccgtccttgttcaccggcccgtcgatggtggtggcggcgaagaagatgcggccgtgctcgtagcggacgtccaggtagtcgaagaacgacatgccgtcggtgccgaagagcaggagcagcgtctccttccccgacgcggtgtcgatgctcacggcggcgctgggcgcgtatctggagacggaagaccggtaggcgatgagtctgtccccgctcatccggacggggtacatggggcggccgaccttggcgtcgaacttccggacgctcttcccggtggccaggtcgaaggcgacgatctcgttggccacctggccgtgggcgctccccgcgacgtagtcgcgcccctgggtggcgacgtacagctgccggtccccgaccaccacggcctcgcaggtctcgaccgggcccgtgatgtccgtggcgcacttggtgacgtacctctggccgggcaccgagagcgaggcgcggaccgtgccccggtcgctgagggagatgaggtcggtgatctcgggggcgcccgccgcgacggcgatgacgacgggggacgaggagaccagacggacgtcctggaccccggggtccacctggtaggtccacagtgacttcccggtcctggggttcgtcccctccacccggaaccgcctgttgtccgcgttcccgcacttgacgaggcgcacgagggccttgcccccggcgtacccgctgtccccgcagaccgccccgggcacatgcgaccagagcagcttcccgtcggccatggcgtacgccgccgagccgtccttccaggaggcgatgacctttccgcgcgtcatggtgacggtggcgggcacaagttccttctcgggcagcttgacgtgccacagccgcttgcccgtgtcgatgtcgaacatggcgatctcgtcgcaggggccgctcatgaccccaccgctcgggtcggttctggtcgcctcgcccgagaaggccacggcggtacggccgtccacggtgacgtgtggggtggcggcgcagacagcgccggggaagccgattttccacgcttccttgttggtcgcgatcttgaacccggtgatgcggttgcccagggtcttcgcgaagaccttgccggtcgcccaggtacccgtggcctcgatggtctggcccgccttgacgcccttggcgcggcgcgtgaccgctgtcgccccttccggcgtcgccgggcgccgctcgaccgtctcccggatggcgtcgggatcttgccgggaggccgtcgggcgctggtcggagggggtgtgggaaagtccccagattcccgcgcagagcaccgcgacagcggccgccgcggcaccgaggatccgcaaccgacggcgcttcctccggttctcggattccagggtggatgcggtgtagggagacggcggaggaccgaaactcactggaacggggcctttctgcctgctgggttgacggaatcgccgccctcacggacgtaccttcgcgatcccctgaccagggggaacggcggcaagtaggccagccgtacagctcgttgacacaaaaggaggacctgaacggcggattcgatccggagcccacgccgcacggcgggggacccgccacggagtgcccggagcgggacaaaggggcggcacgcgcgcgttgccgccccggctcttgctcagtggctgaccccggcgctccccactccgatcgctgccagcaccgggtccttggggtgcttgtcgtcggcggtcagttcccgcttcgcgaagaagaccctgtccttctcgacgatgatgtccgactgttccgggtcgctcagctcggactcctcgtcctccgggaggtggaagaggaggaacggtgactccttgtcggtacgggggttccagcgcaccacggccgccggtccgacgctgccgaaggtccgccggtagatcagaagctcgtcgccgctcatgcgcaacggaagaaccgactggaaggagcgtccgtcgaacttccccgccgtcttgcccgttctgacatcgaacgccacgatccagttcgccggctgagcggcgtcgaagccctccttggtggcgacgtacatctgcttgcgccccacgaccatcttgtcgcagttctccatcacaccgaagtacggcgccgcgaagtagcgctgcccgcacccggggtcgtagcgattgcccgccagagagaccgtggcgaggtgtttgcccttgtcgtccagcgtgatcaagtcggtcaccgtgatgtccccggccgcgacggcgaggaccggcggatcggacgagggcatgtacacggcctggatgccgccggcgaccttgtacgtccagtcggccctgcccgtgcgggggtcgagcttctgcacctcgtacttggtgtcgggcgcctccccgcagctgaccagggcgagcagggcgcgaccgccggcgaagccctcgtcctcgcagttggaaacagcggtgctgtcccagagctgcttgccgttcttcatgtcgtaagccaccgagccatgcctccaggccacggcgacgacgcctcgcgtgagagtcaggttcgtgttcgtcacgtaggcctggttcgccgagggcatcttcgcctgccagagctttttgccggtgtccagatcgaagaacaccacctcgttgcagacgcccgcggtcttggagccctcgggcttgctgggctgaacgacgaccgccgtacgaccgtcggctgtgacatgtctgctggtggcgcagatgtggccgccgagctcgagggtccaggccgccttctcgctctgggactggatcttgtagcccacgaccttgcgggcaatacccttggcgaagatcttgcccgtggcccaagtgccgggcgcgtagcgcgggtcggtggtgttcttggccaggccgtcctcgctgtgttcgatcaccagccggccctcgggtgtgctggggatcttctcgaccgtctccctgatctcatcagggcgctgcgaggcggcggccgccttgccatcggccggtgcgtcgtcgcccgcggacaacaggagccagccgcccacgcacagcacggcgacgacgagtgcggccacggcgcccaccaccttcatgcggccgcggctgcgggcctggtccgccgccagtgcggattgggtgtagacggacggtggtgggccgaagctcacgttgggaggcctttctgacagtggtcgtgtctcgacggtgatcacggctcggtccgcgccggggctcggccggtcggcgtggtccgggccgagcccgaggtcatggggtgtggggtatcagcgcgggcagcgcgtgccgagcagggccggtcccctagctggtcatggcccgcgcctgcgcgtacacgtcgaagacagccagagccagcgggatcagcgtcagcaggacgaaactctcggcgatctccaagaagcgtccccagaagggggtcacgccgcgcttcggagtgaccaggccgatcgcggtgaccaggacggtggccgcggcgaccgccgcggcgagccagacgctgcggatgtcgagggcggtggtgtctccctggagagcaccgcgccagtacccctgcggcgggttcagggcgagcccgaggccaaggaggacgagagccgcgaggccggcggccaaagtggcgccgacctgcgcggtgtagcggaacagatgggcacgcatcagcatcgccacgcctgtcgcgagggcgaggagttgtgcccacgcgttgctggagaagccgaggacgaccgacgcgcctacggagaccagcgcacagccgccgaccagaccgacgagaagttcgtgaccgcggcgggcctgggccgcgacgcgctcggcgtcgacgggctcctggggggcgggctcgcccgggtcgtagccgccgcgggacgggttgggcggttcgaagccgatgggcagccgggcgaagcgcatggacaggcccggcaggaaggcgagtgcgcagaccgagagcggggcgcagacggcagccgtctccatgggtttcagatccgtgagaatcgcgatgaaggtggtgagcaggccgatcgtggccgcgaagacgaacgccacgaagggcccgtcgcccctcggcgacaccaaggtgagcaccacggacgcgaccaggaccgccgtgcaggcgagcaggaactggagccgtccgatcccctgcccgtcggagagcggcagcagcccggagcccgccaccgcgacgttcggcagggcgccgagccccagagcgacggccgagccccggtcgtcgtacacgcgggcgcggacgcacgcgagggtgaccaggaggatgccggcgacggcggccaggacaccctgaaggctgtgcatgtcgtggcggatctgggaactccagaccacgaaggcgagcagtgcgggcaggatgccgcccgcgacgagaccggccgtgcgcgtcagttcgccgctccacaggctgcggtcgcgggtgacggcggaggcgacggcttcggagacgtcgtcgaagacggccggcggaagcgactcggagaacgggcgcagcgtgagcagttcaccgtccaggatgcgctgggccgcgaacgagcgggcgctgtcgaggacggacccgtcgcggcgtacgagggagtagccgacgggggcgccctcggccggactctgctgggacagtcgcaggatttccgggtacaggtcggcgaccggtacgtcatcgggcaacgccacatcgatccggctgtcgggcgccacgatggtgacccggcagaagccgagtcctgcgcccgccccggcaggggccgtggtgcccgctccgccggtcgcgccggtcggcacggaggccgtcatgctcacctgctgttccccctcgatcagtggtgcgcacagctctgcgggcgaccgcggacgtccgcccgtggagatcctgtgcacgttgcgccgcgaccccgcggggtcggccccttgtgccgtcgtgccggtcacttcgaggtgagcggctgtcccgaaccacgcccaatgcccgtttttcctgggccgatccgcggctgctcacgcgtaccaccggcaccctaccgcccaccgttgtcagcggtcgtcagtaggatcgcaaacagcgatcggcgtccgcccgacacggggcggcggacggaacaactcggtccggcaagggaattggtgcgaagtgagccacatcgtggtcaagcgtccgcctcgggcgctgccgtccgaagtgcccacggaagaggtcgtactacagcctccgccggagcttccgcgcgggcagcaggagggcgctctgatgcagctcctgccgatgctcggcatgggcggctccgtggtgttcttcttcaatccgcaggcgcagcccttcatgaagatcatgggcatggtgatggtggcctccaccatcgccatgggcatctcgatgctcatccgctaccgccgcggcagccagggacagatggcggacatgcgccgcgactatctccgttacctgtcacggacccggcgtgccgccgcggacgccgcgaaggcacagcgcgacgcgcagtactacttgcacccttcgcccgagcaactgtgggcactggtcgccgagggcagtcgagtatgggaacgacgcaccagcgacgaggacttcgcgcaggtgcgcgtgggtctcggaccgcaggcgctggcgacccccctagtgccgccggagaccgccccggtcgacgagctggagccgctgacagcgagcgcgatgcagcgtttcctggccacgtacagcgtcctcgaggaactgccgatggcggtgtcgctgcgcgccttctaccacgtcacggtcagcggcgagccgacgaccgtacggggcacggcccgcgcccttgccgcctcgcttgcgtccctgcactcccccgaggacctggtcatcgcggtcgcggccgcccgtgagtcgctgcccgagtgggagtgggccaagtggctgccgcacacccaggcaccgggcctcgcggacggagcgggcagccggcgtctgatcgccggcgacccgatgcagttggaggaactgctcgccgcccgcctggagggccgcccgcggttccacccggcgggcgccccggtccccgagcagccgcacctggtcgtcgtactcgacggtctctccctgcctcccacatcgatactggccagccccgagggcctgcaaggggtgacggtcctggaggtcgtgcccggcaacctcaccgccggtcgcggcgacctctccgtcgtcgtacacccgcagctgctgcgcctggagtcggcgcagggttcggtctacgacggcacgccggacgtgctctcgtacgaggccgcggaggcgctcgcccggcagctggcgccgctgcgcgtggcgacgggtggggacgacgacgaaccgctcctcgccaacctggagttcacggatctgctgaacctgggcgacgccgcgtccgtcgacaccaagcgaacgtggcggccgcgctcgcagtccgagcggctgcgcgtaccgatcggtctcggcgaggacggccggcccgtcatgctcgacctcaaggaggcggcgcaggagggcatgggcccgcacggcctgtgcgtcggtgcgacgggttccggcaagtcggagctgctgcgcacgctggtgctcggcctcgcggtcacccactcctcggagacgctgaacttcgtcctcgcggacttcaagggtggtgccacgttcgcggggatggcccagatgccccatgtggcggccgtgatcacgaacctggcggacgacctcaccctcgtcgaccgcatgggcgactcgatccgaggtgagctcaaccgccgccaggagatgctgcgcgacgcgggcaactacgcgaacatccacgactacgagaaggcgcgcgcggccggtgccccgttgcagccgattccgtcactcgtcctggtgatcgacgagttctccgaactgctcacggccaagccggacttcatcgagatgttcgtgcagatcggccgtatcgggcgttcgctgggggtgcatctgctgctcgcttcgcagcgcctggaggagggccgccttcggggcctggagacctacctctcgtaccgcatcggtctgcggacgttctcggcggccgagtcgcgtgcggcgctcggtgtccccgacgcgtacgagctgccgaacgttccgggttccggtttcctgaagttcggcaccgacgaaatggtgcgcttcaaggcggcgtacgtgtccggggtgtaccgctccggttcctcgcaggccgcggcgctcggcgggccgcttccggtggaccggcgcccggtgctgttcacggcggccgaggtgccggtgcagtacctgccggtgccgcagcagcgccggcaggccccggacgagaaggacgacgcgctcgcggacacggtgctcgatgtcatcgtgcgccgtctggaggcgcaggggcctgcggcgcatcaggtgtggctgcccccgctggacagcccgccggcgctcgactcgctgcttccgggcctcgccgcggtgcagggtcgcggcctcacccagcccggatacgagggcgcgggacggctcgtcgtcccggtcggtatcgtcgacaagccgtacgagcaacggcgtgacccgctgtggaccgacttcagcggcgccgcgggccacatgcagatcctgggcggcccgcagtcgggcaagtccaccctcgtgcgctcgctcatcacctcgttcgcgctgacgcacactccgcacgaagtgcagttctacgggctcgacttcggcggcggcggcatggccgccctggccgacctgccgcacgtcggaggggtggcctcgcgcctcgaccccgagaaggtgcggcgtacggcggccgaggtgtacggcgtgatgacgcgccgcgaggagtacttccgcaccacgggcatcgcctcgatcgccgacttccgcgcccgccgcgcccggggcgacatctcgacggccgatcagccttggggcgacgtgttcctggtcatcgacggctggggcaacttccgtacggactacgaggcgctggagccggtcgtcctggacatcgccgcgcgtggcctcggttacggcatccacctcgtcctcacggcgtcgcgctccatggaggtgcgttcgaacctcaaggaccacctgatgaaccgcctggagctgcggctcggcgaccccatggactcggagttcgaccgcaaggtcgccgccaacgtgcccaccggtgtgccggggcgcggccagaccccgcagaagcagcacttcatggcggcggtgccgcgcatcgacggcctgtcctcggacacggatctggccgaggccacgaccgctctcgcgaccgaggtgacgcggcactggacacagcccggcgcgcccaaggtccggctgctgccgacggagttcccggcgagtcagctgccgcccggtgacaggttcccgaagctcggtgtctccttcgcgctggacgagaacaacctcgagccggtgttcgtggacttcgagcaggacccgttcttcctcatcttcggagagagcgagtccggcaagtcgaatctcctgcggctgctcatcaagcgcatcaccgagcgcaacgacggcaacagcaccaagctgttcgtggtcgacaaccgccggtccctgctggacgccaccccggctacgcacctggccgagtacatccccatgtcgaaccagatgcagcaccacatggacgccctggccgacctcatgcagcgccgcaccccgaccgcggaggtgacggcccagcagctgcgcgaccgcagctggtggcgcggcccgacggtgtacgtcgtcatcgacgactacgacctggtgtccacgtcgagcggcaatccgctggcaggcctcaccgaaatgctgccgttcgcgcgggacgtgggcgtgcggttcatcatcgcccgctccacggccggcgcggggcgggccggctacgagaccttcatgcagcgcatcaaggaactcggcgcgcagggcgtcgtcctctccggcgacccgggggagggtgacctgctcggcggggtgcggccgcggcccatgacggcggggcggggcgtgttcgtgtcacgtcggcgcggaaagcctttgattcaggtgggacttgcggaaaccgcggagtactgagggccgaggagtacgtgcgcaaactgtccggcgcgcggtgccgggcccccagtaggctgatccctcggttggttcgcacccttcgtggttcgcgccgttcatcgttcgcacagttcagcaggtacgtcggagaggggccgcccaccatggccgacacgcaggagaacaccgccgcagagacggtggacgaggacgtcaaggcccgcaaggagcgcgagaagaacgagctgtacgcgctcgacatctccggcgtcgagtggcacagcgcaccgggtaccgaggagcacgaggagcgcgtcgagatcgcgtatctgccggacggggcggtggcgatgcggtcgtcgctcgatccggagaccgtgttgcggtacacggaggcggagtggacggcgttcgtcctgggcgcgcgggacggggagttcgacctggagccgacagagcacaacggggggcttgcggcggagtaggcggagtaggcggagtagctcgcgggaggggccggggggctgggggcgccccggccggggcggggcaaccgttcgagcacgcctcacccccggcgtcagcccatgcaccggctcctcgctagcctgccggtatgcgcaacggggacgacgatcacatcggacatgacgacgccggatccgctgccggcggtgccggcaacggggccgaccagggggacgccgcgctgtccgcgcctccctcccccgtcggccgccgcgcctggctgcgaagtcaccggctgctcgtctccgccatggcgacggcggtcgtggctctggcggtggccatccccctgaccgtctccgactcggccgacgcggcgccctgttggagcgttcccgccaaggcccgcgccctggcgggtgatccggccgccgcccgcaaggcactcgacccgctggacgacgcgagcaacctgcagcgggcccgtcggctgctcacccacgaccgcgtctgcggcgacggggccaaggtcctcggccgtatcgtcaccgccgccacttcggccaccacctccggcagcccgcacaccatggcccaggcccgctccgccttcgcggtcgcctcggcgctctcacaccgggaaatcccgcccggcctggctccggcggtggcccgcatgctggcggagtacgtggtggacgtgacgcgcgacgtctccgacggccatgaccgcgacgcgaccggccccgcggaatccgccgaaggggccgccctggacgacaccggcttcacgccctacggccgcttcctggccccgcacgaggcccacaccaacttcggtctctacgagggtctggacagcgcacaccatgtctccctcggcgttgtcatcaccgagctggccaaggacccggaagccttcgcgatcctctacgacgccgaacgcacctacttcgcacactacttggaacgtctgaccgaccgcgcgggcgatccggccgcccgcctcaccgccaaaagcaaggccgaggacaagaagttcggcgaggactggcacgcgtacgacaccgactggccggacaacgacctggaggacatcaccgacgtcatcgcagccctcatgcaggcccgcacgcggtacgcgaagaacggcacgatcacggacctggccgcgttcgacaagtcggtgcgcgcccacaccgacggcgcctaccgccccgcggccgaccgcgtgaccacccgcccgccgatgggcgacatcgcggagcggccgccgtcggcgcgggtacgcggtgacttgttcgacgggcggcagcagttgttcacggtgtacgacgcctgggtgcgcgatcgcgacattccggccgaacgagcgggcacactacggcagttgctggacgatcactatgtacgggggttgtggctggggcgcttttgagcgtgtcgcgcggtcgacgccgcccggcatgatgtcagaaggagaacttcggctcgcccacacacccgtcgtgccgctccatctggtccgcgacgaacagccgcagcaaccgccgctcgtcggcctcgctcacgccctcgctcagaccgaggtcgcgcacgccgtcggaggagtccagggagaagttggccgcctcgccgtcacagcgcaccgtggccgtcatggacgacctcccgccgtgcgtggaatcgcgggtgacgaaccgattgctccagtctccgtaccaggcgtacaggccgatcgactcgccgccggcctccgtcacccccgcctcctccggcacgtccaggtggcaggacgcgagcggtgccgccgcgctgccttccccggacacccgccagtccaccccgtcgggcaggccggctccggcaacccaggcacagggcgtcttctccgcgtcggcgagaaccaccccccggggatcgtcgcttcgccccggatcggccagagcggccgcggccgccgtcctggtcaacgtcagcggatcggcgccgcaccccagccgcttcgacgccgtgttggtgaaggagacggcggcccggtacgccgtaccgcccgcaccgacgagcgcgtcttcggcgaaggagacacgggacaccaacctccgggcccgtccctccgcgtccttgccgaggtccgggcagggcacttgcagtacaacgtcccggaagcggtcgacgaaaccgggaaggccgcccggaagcacggtgtgcgtcgcggagccgtactccgggaaggagtcgaagaacgccaggtcctggtcgtcacgccgggtgtaggccgacatggccagcaggtcccagtcgcgcgcgtggtcgccctgcttggcggtgagcacgcaggtgtacgttcccagctgctcgatctgccggccccgggactccttcaagtgcgtgtcttccgggatgagttggtcgaccgtgtcccgggagacggctccgtcgcacacgtcccgggcgacggcccagtcctggacgtagggctcggctgtccaggcgccgccggagaggaccacggcggccgcgacggaccaggtgagcaggcggcgggtgcgggggttcattgagagtggggttcctgtcgtctcagcacacggtcaggacgacaactgtgctgtcgctcatgacgaaatcaaggtctccgtcggcggccatccggacgtactggggcacggggagtgtgtctccccatgcgcacttttgccgctgaacacccgcattgtcttgatctccacgtcggatgcgcatgcaagagagttgagggcccagacacctcgcccctgcggcaaggcgggcgggctcggtgcggtcaccctcggcgccgccgacgatgaagttgcgctcggggacgggcccttgccctgggtggttccaatggcacagcaagagggtgggcgtctcccgcgcacgcccaccctgcgttgcttgcttgccttgcttgccttgcttgccttgcttgccttgcttgccttgcttgccttgcttgccttgctgctacgacctcgtactacaggaagtagctggcggccttcttgtcgccacccatgtacgtaccaccggccgtaccgacggcgtgaccgatgccggtcagcgcggtgtggatgtcgttggcttccttgtcccacctggcgagcttgctgtcgaacgcgtcctgggccgcgccgtcccagtactgcttgcactgggccacgagcttcttgagctcctggaggtcctgctcgagggtcttcgcctcgttaccgatactcgtcgccgcgaagtcaagtgcgtcataagtgacttgcgttccgtctgcgttggtcgccatacctgtctacctcgtctcgctcggtcgtaccgatgacccttgatgcactgccactgccactgccatgcgcgccgcagtgctcagtagttgttgaacgcggatgcggtgaccgtcggagcgccgtcctgaaggtcgatcttctgcacggccgcgcgcacctcgtcctcgctgccgtccgtgatctttcgcgtcttgttcacgccttcgatgacctcggtgaggatgccacccagggctcccagggactggttgatctcgtactgcttcttgtcgaaagcggcacgcccgattccctgccactggccctcaagtccgtcgatgacaccctgaagcttgtgcacccgtgccctgatggcctcgaacttggtgtacatgtcctgctccagcttgattactggatcattgttgaccttcatgccattggtggccataaccagcccgcccttcttctgtctgttttctcagtccgaccgtctcggctccccgccgtaacggtgagcgcagttccctgccctatacgaacggtgcagggcacaaccgaccgacgacgtcacctggcacgtcgcgcccgcatcacagctgctccggcgccgccgatcacgatgaccgcggcggctgcgcccagcgcaatccacagcgaattactgtcgttcgacgactccgcacttgatcctgccgccgatgtcgcgccacctgaagtgtccttcggggcttgtgacgaggctgatgcggaaggggagggagccggcgagacttccgtcaccagctcctctccatccgtcttgttctccttggcgagcgggtcggagtaggcggggccggcgttgtagtgggggtttgccaggaccttgcgggggcggacaagcccatagcccgcgtacttactcggattgcccttcgcccaagtacggccggccgtatcgatcaacgaacgggtgacctgattgaccgtccagtcggggtgagcagaccagatcaaggcggcggaggctgaagcgattgcggcagccgggctcgtaccgttgcgatcgtcgcagtacgagcggaagttggcgttacaccagccggggaaaccctcgcccggtgccaccaggtcgacatagtttccgcttgaagaaaacttcgacaccgtcaaggacttattggccgatgcaatgccaaccacgtagggataggcggcgggatagtcgatcaagccgctccccccgtcactcgcattgttcccgactgcggcgatcaatagcttgccctttgacgcggcgtatttgaccgccgcttcatcctcatcggtggtcatgccgccgaacgacatactgatgatctttgcgtcggtgtcggcggccgccctgagagcctcccaggccttgggtgtcttgtctttctccgccccgctcttgagaccctcaagctgaacgcgataggggacgatcttcgcacccggcgccaaaccttgcagcccaccgccggaccccgtgcctgcgatcaactcagccatgctcgttccatggccgacgtagtcgtccgtggcgtggtaggcaaccgacttggggacctcaccggccaggacttgccctgtcaacgcggacgtatccgcgttcacccctgtgtcgataagggcaatcttgacgcctttccccgtgctggccttccacatctgctcggcctgcatcgattccaagtaccactgtttcgactgagcgtcgtacgcggcggcactcggggcgaaccccatactcacaactgtcagggcgccgacgaccgcgcccacagctcgcactcgcctcgcgcagcacgtcctgaggatcgcagtccgctcatctcgtcgactggtccctgacttcatggctttgttatgtcctcgttcgcgttcagctgatggtcggcggcacatcgcgtcgcggccgagtgggcagatgcgtctcttcgtcttcaaccaagtactcggggcgcttcggtcccccggtgctctgcccatcactggacttcgcctggccgccaggcccacgcacaagaccgacacctccgcgcgtcatgccgctgcgctcggctccggcaacagagttgcgtgcggagggcctgccggtgacagcctccgacgttcccgcacctccacgagaggcggtcgcactcgaacccggcctggcagtgggctcgggcgctccgaagactccacgctggccgggtcggccattcgcagcggtccgggagttggccgtttcctcggctccgatgaccgtgccacgaggaattctcggcccgcccttccccgaagcgccgccagcagtcgtgggtcgccccccgaccacgccgttcgaacggccggcaccagtggtcgggccaccggcgccccgtggcattgcctcgccaccgacccgcggggtgccaccggtgacacctctgcccatcgaggacgacttcgccccggaagcagtgctcttggcagccgactgtccagtcgccgtggggcggcccatctggttcatgggccctctccccccagaccgccccgtgccctggttgctcaaaccggacgcaccggcccggccctgagcggacgcggggggccggacaccaccggctccaccgcccctgcctgacgtgccgttgggaaccggggtcccgtagccgccgtcgaacgcgctggtcgggccgccacctgtgcccggggcagctgtgactggtggggtgtgaccggtcccgggtgcggttacgggtggcggcaacgtgccgacgctgtcgatgttcgtacgggcaggatcatcgggaggcggagtcctcccggtagcgtcataggaaggcgtaggtgtatcgattgaaggcgtaggcgtatcgattgcggcgcgtgagccagcatggcccgctgccccggccgtcgcgtgatggttcacgccggcggtcgatccgtccgaggccgcccctcccgaaccatgcacttgcgcatatgaggtgggcgcaggtacacccacgtcaggcatggccttgaatgtcggcgcctccgagttcaaggcaaccagcgcctcgtgcgacaccgagtagtacgacgacaaccgattcatctggttgatcgcttcttgccggtccttctccacccggacggcagtggcgtactcctcgttactttcgacctgcttggccttcgggagctgctcgggtcgcgtcgcatgcggtcgctgatcgcgaggtggcatggcactgcgtacgttcgccaggcccacagcgacggcggtgatctgatcgcccgccccgccggcgaagtcactcagtttctgcgtgctggcgacgagcgaacggctccacgtacggaaggcatcgcccgactctccgacccagtggacgttctcgatgtggccgtcgagttccttggctgccgccttaatggcgtcccgcgcgtcccacagggcgaaccctgaggactccaggtcctccgggttcgtctgctcgaccaggtcgagcatctggttgaggtcgtgcagctcgaagttcgtacggccgtgcatggcctgcccgaacggggtggcgtcgaccgccgagcgcaccaagttgttgaagagcccacctcgtggccgctcctcaaccccccgagcgaagtccgtgatggagttctgactggcgactcggtccaggtcggccttgtgctgcttgtcggtcattgtcatcccttcaagctggtgccgtcgccggagtgctcgctgcccttcgcgccccgaatctccttgatctcagtctggatcgcccagaaccgccgacgctgctcctcttcgaggttgtcgaagccccgatgcgcgccctgaacggcgataccgatcgcctcgatctgcaggtgcagggtcctggagagggaagtgagcttctcgtggaccgcgttgtactgcgcgtacaggtcgtccgcctcaggaaaggcaccctgcttgccgctgttcagcgacgcgggccggatcgtctgggcaccgacccgcttcgggttgcccgccgacgcctcgagctcgctgaggaccgtgtccacccgcttcatgaacgtggacaacgcctcaccactgacctccaggttcgccgccctggtagccgacacgccccccaccatgtctgccggaagcacgacactcctccccgttttccccgtatgaccgtcgtgcgcactgccgttcggccctcgatacgatcgcaaagcgagccgcgccacacaacgcttttaccactgtagtcactgtgcgcatccagtccaacagagccgcgtgttagctcagttacggggccgcttcagacatcactcttcggccgatctgccggtttgccgcaaatggtcgtggaagcctcggcggcagccgtggtacggccctaccttcccgggggcgaccgttgatgctgccgccgcgacccccttggctaccttcaacaaatttccacacgtgatcgacggcggctccacggcaactacccctgtacacgggcggagttgctagcgtgcttcggactacccgccgaagcacgctgacgtctcagggttcggtggggacagcaggcaggcattgatcaccacgggggaagggtcctgcaagtggcatgggacgagtgggaacagctcaagagcgaggcgcaacagcgtcagcagggcaccacgcacatgcagctcaaccagcttccggtcgatcctggcggcggtagcactcagggtgacctcaaagtcagccagaaggacctcgccgcgatcggcgacgcggcatacgagttgaatcaggcgttcgagcacttcagcgacctcgcccgaatgagctcgatcgcggcgggggatggcttgaaaggcgagggttatgcgatcggttcggcgctggatcacgtagcggagcgctgggtggaccaggtccggtcgcttctggacgccacggcccacatctccaaccacctggactacaccaagggcgcgcacgccggcgacgaggtctatatcgccggcactctcagcagcatcgccacgctcgaccagggtttcgacgagcggaagggcagctgaaccagtggatctcgactcgctccggcagggcaacttccatcagctcggtgaagcgatcaccgactggcagaacatgacgaagcacctcaagactctcgccgaggacgctgacaagaacctcaagggcaaggcacacaaagccaactgggccggcatgaacgccaccgtcactcgcgagttcatcgacaagacggccggcgagttctccgacgcccatacgcaggccgacacggtcaccaagatcctcagcgatacccggggcgagctcatcgactaccgcacccaggtcaatgacgccatcgatcgagggctgaagaagaacctgaccgtgatggacatgggcgacggctccttcgtggtcaccaggtccacccgccccgactgggcttccgatccaagtggtcagaacgacacaacgagccagaaggacgcggacgatctccgcgacgagatccagcgcattctcgacaaggccacggagagcgactccactgccgccaaggcgctgcgtctcatcgccgaccaggccaagtacggcttctccgacgccagctacgcagaccgggactccgcagcgaaggccctcgcggacgccgacaagatggccaagatcctcgcgaagaacccgcatgacgtgacgaacacggagctcgcgtccctcaactccaccctggccaagtacaagggcgatccgctcttcgccgaggagttcgccacaagcgtcggccccaagaaacttctcaccttctatgccgggatcgcggacccctatcaggcccagtacgaccccgaacgcggcaagcaggcaaaacagctccagaagaacctcggaatcaccatcggtcaggcgacgctctccgacagcgatgcaatgcagggctgggagaaaaagatgatcaagttgggtcccggccaactcgacatcgacgacgcgagcaacccgaccggctatgccgccatgagcaacctgatgcgcttcggtgactacgacgaccagttcctcaacaactacggcaacaagctcttcgcatacgacaaacaggtcaacggtgaggccatcagcctctgggtgaacaacgccaaccagggcgacctcaactactggggctacaagaacgatcgcggccgcgacccggtgacgggcttcctggaggctttggggcacaacccggacgcgtcgacccagttcttcgcgcagcccgacggcgcaggtgccaccgtcaacaagggctccgaggtcaacgaccatctgaagtacctgacccaggagcgcgtctgggcgtccgacgtgaccctcgagggcaagcacggctacgtcgctggacgcgactctctcggccatgccctggaatccgcgacgacaggctacgcctacgacgccaaaccgatgacagagaaggatccgatgatccctggcagcggtgaccgccgcaccgcagccacggccggggtaatggaggaggtcgcgtacctctacggcagcgaagacggtcccaagatgctgcgcggccagccggaattggcagacagtttgggcaagatggccggcgcgtacatcgacgacattgactacagcctgtctggtgtcggagaaagcgcgaaggacgccgacaccttccctgccaaataccaagggcgggcggacttcaccaacgcaggcgcaatcaacttcctgagcgtactcgggcaggatgagaactcccaccgcgccgtcaccgcagcgcagcacctgtatacgctcagccaactcgacgcccacccatccaccagcgatgccaacatcgagcatgcccacgacgccctggttaccggatcccaagttcggggcattctggataattcccgcgtcgagcaggcccagaccgactacggcgaaggctcggaggagagcaataaatcgctgggccgttccgccgactggatcaaactgggggccggtgcggtcgtcgcggggggtgtcgccgccatccccctccccgggacgagtgccgcggcactcgtggtcgcaccgctggcagcggacaccgtgggcgaggcggtgaacaccttcatcggccagcagatcgacaagggtgtggacgacgcagaagcggatcccgccgagaaatcgcagttgaccagcagccagttctatggcaagggcgccaatcagctcggtgccgcttaccagtcctacattgaagacagttcaaaagctgccgacgtcgctggcaaggaggattggaaggatgacatcaacaacgcttactacgggacgggatcacacgagaacgagtatcgcgggcgtgcttcgtacaaggattgaactgtgcaactgacaagcgaacgacgacagagtccggcaatgctgctcacggcactgggcccagccgtctgctgcatcgcactgattctcggcctctctgcgtgcagtggtggcaacggtgacaagaaggagcggagcctgactgccgccgaggtctgcgactccacgttggactcctccgcgatcgcggggctaaaacgcatgggggacactcagaagttcactgaacttcccggaacagacgactcgggggaacccaacaagttctcactgaaacgggccgcaagcactattcatgatgacatgacgcagcgaaaccagtgcgttgtctacaagacaggagatacgactgggcatcccttgatcgatgtggacttctctgctgtcaagtatcacccgaactcagagaaacccactgcggatgcaagtgcagagctgaccatctacccaatcggcgtatacgcggcgacgcacggaaacgcaagcgcttcactctacttcaaatgccccacaaaggacccagagggaacgaaaccgtacatccaggcaagtgtgcacagcaccgctgatcaggtgtccgccaaggccaccgccaaggacagcatggacatcctcaactccgtctcgcggagcatggcgaagcagctgggctgcgcatcccaggccgaccttcccgccaacgtcccgctgcccgagcagagttgatggggacaggattgaatgggcgaggggcactgccgagcacccgaggtctgcccggtcgctcacgctgttcgctagccggtgaccagacgttgcatccgggagcgcggcggtcttcagcccctggcgacgcactgactgctttgcctgaaggcatactgtctgcggggacctggttgaacgtgcccccggaggaacaggcgagtttcatgaactcaccgtcaggcaccctcgcgcacgccgttcttctccacctgcttcgcacgttggacagcgaaggggtagcggtcttcggcgagagccgtgaaggccagagctgtggcgaggaaggagcggtggacgcgcgggatcggatgctcggagtcgtcgtcggcacgggagctcttcctgtgagagacggttgcggggggtgggacggggcggacggtcggccggcgaaaagcgtcagcactccccctcatccaccgtcgccgcaagttcgtactcgggaatggtcaccgtgccctcgccgcccgcgacgcccggtggcgtgtagccgccgtccttcgactccgtgcgcttgacgtgcatgcagaaggcggccttcgcgccgtcggccttgatcgtgtagtccgcgtccttggccgtgttcgtgtcggcggggaaagcgtcgaccccggactgcggggcgtcgccgccgccatgctggacgacctcgtcctcgatcatggacttgatgtcgttgccgacggagtcgatctcgaaataggaacgcgcgtccaaggcggtggtggccccctggaccgccttcgtcaactcgctgtcgctccacgacacgtcgtccgagacggccaggagctgaaagccctgaaaggccatgatgccggccaggacgaagaagacggcacgccccgcgacgaaagcggaggacgggagttcgtccgctgacgggttgaagccgtggcgccacgcgcgcacgcggtccgccttgacgcacccggccgcggccatcacgacggcgagggcgaaacaaatggtcgtcatggccgtcatacgccgccccccacacgcccccgccgtctccgcgcatcccgtaccgccaccgcggagcccgtgagtccgaggaccagtaccgccgcgccgaccaccgcgtacgtggccaggcgggtgttgcgttcctccgctgtttcgccgaagtggagggtggggaccgagggggctttggcccgggtcacgccattgaccggcttgggggactcgaccgggtgggccgcgtcgatgtccgagagcgccttgacggggtccaccacgccccagccgaccaggcggtcgtgtccggggatggagcgttccgcggtctgttcgatctgggcgaccacctcttgggccgtccagttcgggtacttggacttcagcagcgccgcgacgcccgccacgtagggggcggagaagcttgtgccgttgtcggagcagtggccgccgccggggaccgtggagatcatgtcgacgccgggggccgcgacaccgacgaagtcgccggactgggagaacgaggcgcgttcgttgttgcggtcggaggcggccaccgccaggacgcccttgtacgacgccgggtaggtggccttgtcgttgccgcccaggccgtcgttgccggccgaggcgacgaccacgaccttctgggtcagggcgtagtcgacggcctcatgcagcttcgggtcgggttcgactgcgttcgccgtgtcctgggagatgttgatgacatcggcgccggcgcccacggcgtaacggatcgcggtggcgagggtgagggccgtgccgtcgccctccgcgttgttctgcttgatcgggatgatcgtggcgtccggggccaggcccacgaatcccgtgcccttgacggagcgggccgcgatgatgccggccacgcgcgtgccgtggccgacggtgtcggtggtgccggacgcgtttccgcggtctatcttctcgcccttggagttcttggcggggaggctgttctcccctttggacgcgtccacggcgttactgagttgggggttcttgacgtcgacccccgtgtcgatcacggccacttggacgcctttgccggtcgacaggtcccacaactggtcgagattcacgcgctgcagtgcccagggccggccctcgtacttcttcgaggggaaggtgcactggccggtcgtcgagtcggcgaccgccgcgggagcggcggccgggagcagcaccgtggtcgccgccaggacggccgttgtggttgcggccagcgccgcgcggcgcgcgaacgtcccgcggagggtggcttcagtgacgtacggcatcggcgtcgacatcatcaactctccaggcaggtgtacgtacttcactcacgatccctgtggctggcgcgccgcggactccgacagtcgggggcccgtcggcaggaaggtcgaccaggcggtggggatcggagccgcatccgtatccgcgtaaccgagcctggtctgggcgatcttggcctccttgagttcctcttcgcgctgcttggccgtggtgccgatgcccttgtcgtcggtggcgctgtcgctgttggactgcagggcgtagcgcaggccggtgtcggtgaccaggaagaccgggcccgccgaggtctcggtgccctggaactggcggtagagctgccccgatccgggcgtcacgtatgcgctggaggagccggagggcagcgaggtggggaactcggtgccggcccaggtcgacagagtggtggcgccgcccttgccgtggaccgagcgcaggacgttgcacacggtgttgcggccgctggtggcgctcgtggcgttgttcaccgtctccggtgcggcctgcggccacttctcgctcgcggcgaagggcgcaccttcgacgatggcgccgggactgacctgctgcgcctcgccggtctggcccacggtgaccagctgggggctgttgaggagcagggtggcggtgaagtcggagatgggggcgacgcggccgggcaggaccacgtaggactgcatcgtggtgcccttgcgggccttgatgatcatgccgaccttgtcggcggagcggaggtcaccgggggcgttcgccgccgcgcccgggatgcccttgaccgtggggatcgagatcgggtcgcgctggtggagcgtgttcagccactgctgcgagacgcgctgcggcttgcgcccctgggtgtcgagcgcgttcagcaggttgtcgtccgtggagtccacgcggtacgcgttgccctgcgcgtcgacgatgtacggcgtcttgttgtcggggccgacgacgtacaggagttcaccgccggccagccggtcggctccgtcggtcttgccgtagtcgcgctgggcgaagacgaaagtggccttctggatggcggtgccgccctggccgggacgttcgcacacagcccagcgcttggcggcgccggcctccttcgccgacggcaggcggtcgggtgcgtaggggatgccgatggtgggaccgtgcggcagcgtgtcgctgtcgaggaccttctcgtcgacggtgatgacggtgtccttgtcgggcgcgaggagcagcttggccgaggccatgttgaggaccggatgcagttgcgccttgccgtcggtctccaggaccacgtaccgggtggtcgagtcgctggcgacgatgacgttcgcgttcggggtcttccagcccttgggagccgtcgggctgaacatgccgatggccccgaacacggccaggatgacgacgccgatgatgacaccgggcagcaccgcgcgcagcggcttcggcgccccttcctccgagcccgagggcgagggctgcacgaaggacgccaggacgcggcgcttcgcgaaggtgtaggcgttgagttcgtcccgccgtgatgccatctgttgtccgctctctccccgtgcggcgctgcggggcgctgtcgtagcggttcccccggccctgtgctgccccggtccgccgcctcggttgcccgcgctgtcagacccggcccctactatgcctgctgtggaacggtacttgcggggcgggtagggtgcctggatcttcaagagccctatgtggtgctgaaattccagcgagttgtgagcaaaacggggggatggagtgatggcttccggaacgcggacccggtcgcgtgaccgggcgcaggcgcggggctcttcagcgccccgtccaggggcggcacagcaaccgtccgcgccggggccgcggccgcaggcgtcgggcgcgctccatctcagaacgcgtcagggacagtccggggcgttccggctgcaacggatcgttctgttggaaatcgcggccgctgttcttctcgccggctgggtgatcgatccgctggcgctggtgccggcagccgtcgtcgccgtcgtactcgtactgctcgccttcgtgcgccgccggggccgctccctgcccgaatggctgggtacggcacgggcgttgaaggcgcggcagcggcgggcagcgagtacgccgataccaccgggtacggagccgggcctcgcacccgcggtggagtgcgacccgagtctgcggacgtatgcgtacggcggacgggaccgacggccggtcgggatcatcggggacgggacgttcgtcaccgctgtgttgcaggtggaggccgacgcgacggcgctgcgtgccgagcgcagtcggcagcccctgccactcggactggtgcgggacgcccttgaagtggacgggatccgcctggagtccgcgcagatcgttctgcacacgcagcccgcgcccgcactgcacctgccgcagcagtccgtggccgtcaccaactacgcgccgctgcaggcgcagacgggcgcacctgccgtgcgcatcacctggatcgcgctgaagctcgacccggagctgtgcccggaggccgtgtccgcgcgcggtggcggactcgtgggggcgcagaagtgcgtcgtgcgcgccgccgaccacctcacgagccgtctgacgggagcgggattccgtacaaccgtgctcaacgaggaggagttgaccgccgccatcgccacctcggcctgcgccaacccgctggtgacggcgggggcggggcggaccgaggcgagggagcggcggaccgaggagtcggggcgcagctggcgttgcgacaaccgcaggcacacgacgtactgggtccgccgctggcccctggtgggcggcgacggacggtcgctgccccaactcgtcgccctgctcacggccgtacccgcgctcgccaccacgttcagtctcacgctggcgcacggcgagcggggcgaggtgtcgctgtgcgggcatctgcgggtgaccgggcgcagtgacgacgaactggtcgcggcgcggcgggcgctggaggaggccgcacgacggggcggcgccgggctcgcccgcctcgaccggcagcaactgcccggcgtgctcgccactctgcctctcgggggtgctcgctgatggccatgaccacggcatcgacaccgggagcgcgggcgtacggcgccccggggaacgccgatggcccgggcgagccctcggtcgccgagcggctgcgcggacgggcgcgcagcgggttcgggctgatcgggccccggcacgggcggcactcgctgtccgtggagcaggtggactcgctcgcgctgcccatcggggacgacggggtcgtcgtcggggtggacgcggaggggcagcccgccgtgctcgggctcaatcggcccactccgtacgacgtcgtcctgatcggtggcctgtggaccgcgcaggtgcttgctctgcgggctgcggcgaccggggcgcgggtcgccgtggagaccgggcgggcaccggcctggatgcagttggtgcatgccatgggcggcggacagaacgggatgtccgtgtacgacgtggggcgggtgccgccgcagggtgcctcggcgggcaacccggtgctggtggtgcgtgactgcggtatgcggccgccgcgggggcgggtcgtctccgggccctggcaggcggtgctgacgctgctgccgtatctcagtccggtggcgccgcggctcatgcggcaggcgcggctcgtcggggtccagcgggtctcgcccgacgaggccgcggagataggccgcacggtggcactgccccggggcgacatggactcgctgccgaccctgcccgacggtgtcacgctctggtgtgccgatcgcgaccggcagtatgtgatgacccagccgaccgacgccgagaccggattgttgggtatgccccgcaggatggactgatcgggcggaactcgatcggattgggttgcttgaggccggttcgcggcttcttgcgtccgattacgtccagttgacgcctagttgttcactccttgttagccatcatcgtcctggtttgtccattctccacgggactggggccgtcacttccgggcaggctgtgacgtagcgggttggcgtggaggggcggacggccctgccgtgggggcgcttgtggtgattaggctgggaccgggcgccacaccgaaacccgtggcggaccgccggcacctcagggggagccgggcggtttcggatccgtcggtcgacttcgggcaacgggatcggacgacttcgtacgaacaagagcggtcgcctcagcgcggcatgagggtgctcgaccacaccaggaggaattgtgaacagcgatcgggacgggatccgcgggggctgggcttcacccgacgatgaccagtccgacgccgagtctgccatcgagatgacgggcgagttcaccatcgactacgcagctcctgcctggtacacgcagaacgcgtcgggaggcgcgacgacggatccggtcgataccgacaccccgggtgcgccggtcgcgcctgctgcaccggtcgggccggccgcgccggtcgcgcctgccgcaccggccttcccggccgggggtccgagcggtggtgtggcggctcccgttccggccgtgccgccgggtccgcccgtggccgcgggtccgcccgcgccgccggtcggtccgcccgtggacctgccgcatccggcgcccgaagaggggtttcccgtgtggactccgccgaccgtcgcggccgaaacggccgccggtgacggggagctcgagagcggcgcgacggtgcggttctcccctgccgcgctcaagcgtgagttcgaggaactcgccgccgcgggcaaggccgttgaggagttcggtgcgggggcgagtgcgggtccggggtctgctcccggtaccggttccgccggtggcgacttcgagttgagcgcgcccacggctccggggggcggccagggagccgagggctccggcgccacggccggcgttgacgccgacgccgacgccgacgccgacgggaacgaccgtgcacacggctcggccgagcccgtttcgacgggcggtacgacgaccggcgccggcgatgcgggcaccgttcctgagggcgcggacgccggtgtgggcgcaggcggtgacgagagtgcaggaggcagcggcgaggccgggcagtccggcgttgccgcgccgtccgcggagggggcctcggacaccgcctccgtcgacaccacgtccgaggacgcgaacacaccacaggctgaggccgcggcctcggacgcggagacggagaccgagacggagacggagacggagacggagacggagacggagacggacacatcgtctgcggacgccgcatcccggggcgccacgttcccaggactccaccgagcaaggccctgccccggaggcgcagaacgcgcaggcctccccggctgcctcggactccgccgacgtcccggattctgcaaacgcatcggccgcatctgccgctccgactccggccgctccggcgaacggtggcgaggcagaccccgccgcccctgccccgaccgcctccaacgacgtaccggccccgcagtcctggaccccgccgccggctccgccgagcgcgcttccgccgttgccgcccgcctatcagccggccgcgcccgcaccggcggcccagtggcccgcgtctccgcagccgggcgagccgacgagccccgaggccgcagcccccgctcccgtccaaggccagccgcagccgcagccgcagccccagccggcggccgcgcagggcgagccggccacggcgccccgggagccgcagccgcagcccccgttccagccgcaggcaccgcagccggcacccgcggcctggaaccagcctgcgccgcccgcacccacggatcccgtgcccccgccggcgccccacgccccgggcccgggtcaccggcgccccggcggcaccgcaggcgggctacggcttcccgcagcccggagttccgactcccccggcgcccgactcccgtgtcaagcaggatggttacgggttcccgcaggccggtgcccagggcgttccgcaagccggccccccggccggccccatctcacccgcagcccaagcggcccccgcacctcccgcggctcccagcgcccccacccctcagcccggctacggcttcccgcagcccggcggacccgttccgccccagagcggctacggcttcccgcagcagggcgctcccgctccgggcccggccgccccacaggaccaaccgcccgccccccaggccggctacggcttcccgcagccgccggccccggccgcaggtcctgatgcgcacaacccgcccaccccgcagcccggctacggcttcccgcagcagggccagccgcccgccccacaagccggctacggcttcccgcagccccccgcgcagcacgcccaggcccagcccgggcagccgcagggtcccgcggtcccgcccgccgcccccgcccctcatcccggcccgcagcccagcggctacggcttcccccaggccaccccaacgccgcccgctccgcccgcccaacaggcgccgcaggcacagccgtctcagccgcagccgcagccccagccccaaccccccgtcgaccctcgcaccggtgccgcctggccgcagcccgtgcagcacgaccagcggcagcccaccaaccccggtgtcgcgcccctcggttacaccgccgcggtggagctgtcctccgaccggctgctcaacaacaagaagcagaaggcgaagagcggccggccgggcgcgggcggtggtctgttcaagctcggagcgaagaaggaagaggccgagcggcagcggaagctggagctgatccgcacgccggtgctgtcgtgctaccggatcgccgtcatcagcctcaagggcggtgtcggcaagacgaccacgaccaccgcgctcggcgccacgctcgccaccgagcggcaggacaagatcctcgcgatcgacgcgaacccggacgccggtacgctcggccgccgcgtgcgccgcgagaccggggccaccatccgcgacctcgtccaggcgatcccgtacctcaactcgtacatggacatccggcggttcacctcgcaggcgccctccggcctggagatcatcgccaacgacgtcgacccggccgtctccacgacgttcaacgacgaggactaccggcgcgcgatcgacgtgctgggcaagcagtacccgatcatcctgaccgactcgggtacgggtctgctctacagcgcgatgcgcggggtgctcgacctcgccgaccagctcatcatcatctcgacgccgtccgtcgacggtgcgagcagtgccagtacgacgctggactggctgtccgcgcacggatacgcggatctggtctcgcggtccatcaccgtcatctccggggtgcgcgagaccggcaagacgatcaaggtggaggacatcgtcggccacttcgagacacggtgccgtggtgtcgtcgtcgtgccgttcgacgagcacctggccgccggtgccgaggtcgacctcgacatgatgcggccgaaggtgcgggaggcgtacttcaacctctccgtgatggtcgccgaggacatggcgcgccaccagcagtcacatgggctgtggacctcggacggcaacccgcccccggtcgcggcaccgccgatgccgggccagccgctgcccggtcagccgatgccggggcagccggctccgggacagcccgtccccgggccgccgtacccgcagcaggggcagcagccgtacccgcagtaccccggctacccgcagcagccgggtcaggcacagccccagccgcaaccgcagggccagccacaaccgcagccgcacccgggacagccctacccgccggcccagcagcagccctacccgccgaacccgaaccagggccaggctcccgggcaggccccgcctcagcagtagtccgcggccagtccgcccgaaccgccgaggacaccggccgcttcctgcgtcgtacgacggagggggcggccggtgtcatgcgctgtacggcgcgacgatcgcaagtgtccccgcgagagcgtcgagggcactcgtccgatgggtgaccgtacggatcccggcgcccgtgtccttggtgcgaaaaccccggtccgtcaggacatagagcatgcgcaacgtgcgcatggtgttggacgcccaggccgggaccggccccggctctcccgtgcggaaggcctcggagacggggtcgagccaccgcgccgactgcgcggcggtgagtccggggtggctcaggatctgcgccagggcgtgggccagtcggtcgtcctcctgcgcgtcgaagaggtgaccggtgggggtgagcagccgtgcgaccgccaactccaggagcggcacggggtcttgtcccgggtggtgggaaacggctgccagcaggtcggcgccgtgggcgacggcgtgcagccagccgagggcggggtcatggccgcgcaggtccgtctcggccggataccagtcggcgaaggcgctccaccaccgcggccgccaggcgcccgcttccacgatccgggccaggaccagcggcgcgaaggcgcgggcctggacggcggggtcggtgaagctcgcggccatgcggtcgcccagccggagccggtccgccgcgtcgaggaccggtatccagcgtgcggccctgacgtaggcctgttcgtcgcgcaccacgggatcgggtgagcgaaggtcctcgacgagcgtgtcgagggcctcggtacgggccgcccccgacagcgtgccgatgtcaccgacgtaggtgcgggaagcagaggtgtccatgggcggaggctatgccgcccccgccccgccgaaccctcgaacgaacggagatccgctccgaacgtaaggagagctactccccgtcgtacgccgcgatcagctcccggcaccgcttgacgtccaccgccatggtttccaggagcgcgtcgatggagtcgaacttggcctggccgcggacgaacgcgaggaagtcgacggcgacgtgcaggccgtacaggtcgaggccgacgcggtcgatggcgtacgcctccaccgtccgctccgtcccgtcgaactgcgggttcgtgccgacggagatcgcggccggcatcgcctcgtccccgacgtgcagccacccggcgtagacgccgtcggcggggatcgcggtgtgcggcagcgtctcgacgttggccgtcgggaagcccagctcacggccgcgctgggcgccgcgtacgacgacgccctcgacgcggtgcgggcgcccgaggatctcgcgcgcgccctccacgtcgccctcggcgatcagccgccgggtcagcgtcgaggagaagggcgtgccgccgcctgcctcaccggtcacgtacagatccaccagctcgacctcgaagtcgtacgtcttcccctgctcggccaggaactccacgttcccggcggccttgtggccgaagcggaagttcgggccctcgaccacggccctggcgtgcagtttgtcgaccagcaccttgaccacgaactcggcgggcgagagccgcgagaactcggtggtgaagggaaggatcagcagcgcgtcgacgcccagctccgccatcagttcggcacggcggtggtgcggggcgagcagcggcgggtggctgccgggccgcacgacctcgctggggtgcgggtcgaaggtcaccacgacggagggaacgcccagctcacgggcgcgttccacggcatgccggatgatcagctggtgtccgcggtggactccgtcgtaggacccgatggtgacgacgctgcgcccccagtcctgggggatgtcctccaagccacgccagcgctgcactgtgaccgctcctcgtcgaacctgtgtccgtgtctgcctcatacgcaggtctaagggtgccatgccgcgtccgttcggcccgcatcggcatgggggctgtgacgggcggcacgtagcgtcaccggccgtcacgggggtttcgcgccggtcaggccgggacgcggacgacgcccgccaggttctcgatcatgcggcgggtgctcggtccgaccaccgcggcccatgcctcgggctccctggtcagccagcgggccacgaggggtgcgaagcccggtacccggcggcccagttctaccagggcctggtcgaaacgggtcgcgccgtcgggagtgcgtacgagcagcagaccggcccggcgcaccagctcacgggtgtgctgctcgccgctgtgccgcgctccgtcggcggcggcgcacagcagggcgacgagcacggcgggatcgcgttcacgcccgagaagcagcccgagcagctcgtgccgcagcggaccggactccgcaccgccgggcgcggcgagaacggtcgtgagcgcgacccgcacctcggggggaccgccgtccagcaggccgccgaccagcggaaggagtacggcccgggaggcgaggccctgctccaggcgccgctcgacgtacgcggcgacgtggtcggccgtctccgggcgcagctccacgacctcgcggaccagggtggcgacccggcgggcgagggcgggcgtggtgacgtcggcgagcgtacgcagcacttcgccgacgtcgggtcccggtcgtcggagccgggcctggaaggcctcgagcaccggctccgggtgggaggcgagggcggtggccagcgcgctcgccggcacctgcgggtcaccctcgccgaagcgtgccagggcctgcgggaggtgccgggagcgggtgcgcggatcgcgcacgagaagcgcgagggcgccgccgtgcagggtgcagtcggcggggcgggcgagcagggcgagcgcggcgtagcgcagcagttcccggccgtcctcggtgcgcacgtgcggagcggcacgcagcccgtaggccacggccgccacccggcgcgcggggcgctcgtcgtgggcccaccggtcgacggcccggcacaccgccgacggctcctcctcggcgagtacggcgagcagctcgtccccgcgccggtgcgcgctgtcggccagcgcctcggtcaggtcgtccagggcgcggcgccggtgcgtgtgcagcagcgcctgggcggcggtggccacggtcgcgtccggggtcgcgggcagcgggcggtcgtcgtcgaaccagcgggtgaggtgggggtgtacggcggcggggtcggcggcgaggagcccggagacggcgtccagatagcgggggccttcggccgggccgcccggcgcctcgtccgcgacgacgagctgtcgcagcaggtcgaaccgctcggtgtcccccaccggcacgctctcccagaacgagggcccgaactcctccggcacacaccgcccttgggcccgccactcgatgatccgcgcggcgaggtgccgcaggacggggaggtacggcgtcgcgtcgggcacgtgcagcagaacgtccgcgaggagccgcacgggccaccaggcggggtggtccgacggagtggggtgtgacggagtggggtgcgacgaagtggggtgcaacagagtggggcccagcggaccggggttcgtcgggacgggggttctcgcggcgagggtcctcgtagcggggggcctcgtggcggggggcctcgtggcggcagtcggcgcggcgaggctctgggcgttgccggccccgggatcggggcgctgcggcagcagtgcgcccgcggcgtcggccaggtcctccagacggagggcgagttcggcggggccctgctggcgagcgaggaggagcagggcctggacgatggggccggtgcggtggcgggggacggggggagtgctgggcggcgtgtcacggtcgcggtggacgagtgcgtgcagcgcggcctccaggtccagatgcatgccctggatccagtcggcgagttcctcgtgggcgaagcggtagccgttgcccgcgggcacgaggaggccctcggtgagaaccgcggtggcccagccggtgatgccgtcgaagggccgtcccggcacgggcccccacgggaacacggcctcgaacgactcgcggtccagctctccctgcccggcccccagacagcggcgcgcggccgcgtggacctgccctgacacccgggcggcgaggcgccgcaccgccgtgccgcgcagcccgtcggccgccgcgagccggaccgcgatgcgcaagcacatcagatccaggtaggaggagaacacctcgtcgcgaccgagccgcccgaaccacgcaccggagccatcggttccgcccaaatcacccgagccacctgacccacgtgaatcacctgagccacccgacgcacgtgaatcacccgagccacgtgcatcgcgcgcgccacgcgagccaccacaaccctctgaatcacccgagccaccaggggccgtcccggcggtccactcgggcagccggtgcgcgagagccgacggcatctcctcgggcccgtccagcaggagcagcaacgggcgccccgcttcccgcgcgacacgggccagccgctccggacggacgtcgccgagcaccccgtccgcgtggcgggctccgccgtccacgccgcccacgccgtccgccgccgccacgatccgcgccgctcgctccagcgcccgtgccgcggcatcggccacggacgtgtcggtggccagcagatccgcaccgcgcagccacagggtgggcgccggttcaggcgcccgggtgcgccgggcggccagggacgccaattcggtcgtacggccgctgcccggggctccgacgagcccgaggacggcggccggaccgtcggcgaatgccgcgaactcccctacgattcgggcgcgttccaccggagcgagggcctcgtgtgctcgggagggcccgtccgagccgaccgtagtggcggccagctccagcactcccgccggattcagatcggcccggtaggccgggacggtcgccgcgttacgggcgagcagctcgtccagcggtccggcggcgcacccggtgccccgcagcggcacggcgaagcccgccgcccggtgctcggtgtgcagggccgtgccgaggacggccaccaccgcgccggtctccgcgtcgagcaccggcccgccggccgctccgccgccgagacgcagcgcgtcgacgcccgccgtgccgatcgccaactccattgcgccgtcgaggagatggcagcggtccgtcgccgtgtacgtcacggcggtcgtgccgagcacccgcgcctcgcgccagccgcccgcgacgagccgcacatacgagccgaccccgacgcggtcccgcacgatgacggggagcggcgccagggcgaggccctccgtgcgtacgatcgccaggcccaggtcgggcaacggggtgaccgcgccggccgtcaccacgcagctgcggtcgcccggcgcgtgcaggaccagccgggacaggccgtcgaccgcctcgtggctggtgagtaccgtgccgtggtggtcggcggcgaagcccgtgccccgcggccgcccggccggatcacagaaccgcaccagcgcggcagccgtcgcgtcctgcccttcccggccggccggcgcgccctccgccgcgtctcgccctccccggccgtcgtcccgtgtccgacggccccgttccgccatactcgaacctccccgccgtgcgcctgacttcgacgttaggcgcggggtgatcagcgggaaagatcgcgcatcgaacgcgcccccttccgctccgtcggttcactccgagcgcctgcccgaaggggtgaatagccgagtgcggatggatacacctctgtgagggggagccgaggggggaccgtggagcggcggccaggacgaacgtccccgtgatcgccgctccacggccgaagaaagcgagtgcacgccggccgaggccacggcagccggtcggcccgcgcgcctcagccgaacacggccaggctcttcgccttgcccttctgctcctccaccagggccaggaagcggcccgcggggtcgacgaccgccaccgcgccgcggcccgcgtactcctcgggcatctccaggcgtacgccgttgagcagcagcctggcccgcttcgtgtccacgtcccagcgggggaacgcggcggcggccgcttcggcgatgggcatcacggtcagctcctcctggagctggtcgagggtgcgcgcggcatcgagcttgtacggtccgacgcgcgtccggcgcagcgccgtcagatgtccgccgacgcccaggtccgcgcccaggtcccgggccagcgcccggatgtacgtgccggacgagcacaccaccgacaccaccaggtcgagcaccggtgtgccgtcctcggcgaccgcgtcacgcacgtcgtacaccgcgaacgacgagacggtcaccgggcgggccgggatctcgaagtcctcgccctcgcgcgcccgcttgtaggaccgcacgccgtcgatcttgatcgcgctgaccttggacggcacctgcatgatggcgccgctgagcttggcgacccccgcgtcgatcgcgtcccgggtcacccgggaggcgtccgtcgaggagatgatctcgccctcggcgtcgtccgtcagggtgttctgcccgagacggatcgtgcccaggtattccttctcggtgagcgcgagatggccgaggagtttggtcgccttctcgacgccgaggacgagcacgcccgtcgccatggggtcgagggtgccggcgtgtccgacgcggcgggtcctggcgatcccgcgcatcttggcgaccacgtcgtgcgaagtgaagcccgacggcttgtccacgatgacaagcccgtcgggcgtcctgtgcttctcggtcattccgcggcgtcgccgtccgtcttggcagcggtgtccgactcgtcgtcggactccggcttgcggtacgggtccgcgtcgcccgcgaactgggcacccgccgagacctcacgcaccttcgcgtccgaggcccgcgccttgtcgagcaggtcctcgatggtcttggcggtgtccggcagggcgtccgccacgaaggtgagggtcggggtgaacttcacgcccgccgccgcacccaccgcggagcggagcacgcccttggcgctctccaggccggcggccgcggccgcccgctcctcgtcgtccccgtacaccgtgtagaagacggtcgcctcccgcagatcacccgtcacccgggtgtccgtgatggtgacctgcgagccgagccgcgggtccttgatcccgcgctgcagcttctgggccaccacctctcggatgaggtccgccagcctcttcgcccgcgcgttgtcggccactggtccgtctccttcttagccttgcttgttctggtcaatcttcgtcgttgtggagcctgcggcgcaccgagagcagttccacctccggtcgccccgccacgagccgttcgcaccggtcgagcacgtcggtgaggtgccctgtgtctccggagaccaccgccaggcctatctcggccctgcggtgaaggtcctgatgacccgtttccgccacgctcacggcgtacttccgctgaagttccgcgacgatcggccggacgagggagcgtttctccttgagcgagcgaacgtcgccgaggagcagatcgaaggacagtgtccccacatacatgtgtatccggatatcccgccggtacggggtcgatggccccgccaacgacttggcggggacatcagaaccgtacaacgaacggccggggccgatcgacggaatactctccgccgaccggccccggaccggaccgatacttcggaaccgaactcttacgagcgcggcttctcgcgcatctcgtaggtcgcgatgacgtcgtcgaccttgatgtcgttgaagtttccgaggttgataccgccctcgaagccttcgcggatctcggtgacgtcgtccttgaagcgacgcagcccggagatgttgaggctctccgcgatgaccttgccgtcgcggatgaggcgcgccttggtgttgcgcttgacctcgcccgagcggaccaggacaccggcgatgttgcccagcttggacgacttgaagacctcgcggatctccgccgtgccgagctcgacctcctcgtactccggcttgagcatgcccttgagggccgcctcgatctcctcgatggcctggtagatcaccgagtagtaccggacgtcgacgccctcgcgctccgccatctgagccgcgcggcccgcagcgcggacgttgaagccgatgacgatggcgtcggagccggtcgccaggttgatgtcggactcggtgaccgcacccacaccgcggtgcaggatgcggatgtcgacctcttcgccgacgtcgagctggagcagcgaggactcgagagcctccaccgaaccggacgcgtcgcccttgatgatgaggttgagttcctgcaccagaccggccttgagggcctcgtccaggttctccagggagaaccggacaccccggcgggcgaagttggcgttgcgctcgcgcgccgcgcgcttctcggcgatctgacgcgccgtgcggtcctcgtcgacaaccaggaagttgtcgccggcgcccgggacgttggtgagaccgaggacgaggaccggggtcgagggacccgcctcttccacgttctcgcccttgtcgtcgagcatcgcgcggacacggccgtacgcgtcgccgaccaccatggtgtcgccgacccgcagggtgcctcgctggaccaggacggtcgcgacggcgccgcggccgcggtcgaggtgggactcgatcgcaataccctgcgcgtcctgctccgggttggcccgcaggtcgagcgaggcgtccgcggtgaggaccacggcctccagcaggctctcgatgttgaggccctgcttggcggagatgtcgacgaacatcgtgtcgccgccgtactcctcggccaccagaccgaactcggtgagctgaccgcgcaccttggtcgggtccgcgccctcgacgtcgatcttgttgaccgcgaccacgatcggcacgtcggccgccttggcgtggttcagcgcctcgatcgtctggggcatcacaccgtcgttggccgccaccacgaggatcgcgatgtcggtcgacttggcaccacgggcacgcatggcggtgaacgcctcgtgaccgggggtgtcgatgaaggtgatcttgcgctcttcgtcgttgacctcggtcgtgacctggtacgcaccgatgtgctgcgtaataccgccggcctcgcccgccacgacgttcgtcttgcggatggtgtcgagcagtcgggtcttaccgtggtcgacgtgacccatgacggtcacgaccggcggacgcgcgacgaggaactcctcgccaccctcgtcctcgccgaactcgatgtcgaaggactcgagcagctcgcggtcctcctcctcggggctgacgatctcgaggacgaagttcatctcgtccgcgaggagcttcagcgtctcgtcggagacggactgcgtggcagtgaccatctcgccgaggttcatcatcacgccgacgagcgacgccgggttggcgccgatcttctccgcgaagtcggtgagggacgcaccgcgcgacaggcggacggactgtccgttgccgcgaggcagcatcacgccgccgaccgacggggcctgcatggcctcgtactcctggcgcctctgccgcttcgacttgcgaccacgacgcgcgggaccgccgggacgaccgaaggcgccctgcgtgccaccacggccacccgggccaccgggacgaccaccgaagccgggacgaccgccgccgccaccgccgggaccacccggacggccggcgaagccgccgccaccgccaccgggaccaccgggacgaccggcgaagccgccaccgccgccaccgggacggccggcgaagccgccgccacccggacgaccgccgccgccaccgggaccaccgggacgaccgccgccaccaggaccgcggccaccggggccaccgccaccgggacgcgggcccgcagcgggacgctgcggcatcatgccggggttcggacggttaccaccaggcgcaccaccgggacggggggcctgcggacggggcatgccgcccggagtcggacgggcaccgcccggaccgccctgcggacgcggagcgccgccgggaccgccctggggacggggagcacggtcctggccgcccgcgccctgcggacgcggaccgccgggggcaccggcgccaccgggacgcggggcaccacccggacggggcgcctgcgggcgcgccatgccggtggagccaccagaggtgaacgggttgttgccgggacgtggaccggccggacgagcgcccggacgcggggcctggccgcccggacgcgcagcgccctgacggtcaccgcggtcaccacggtcaccgcggtcagtgcgttcgccacggacctggccaccctggccctggccgggcgtggccggacgagcgccaccgggcttcggggcaccgggacgggcacccggacgcggaccggaggcggcagcggcgggagccgcgggggccgacggaggcgccgtgaactcgggcgcggccggagccggagccgccggagcgggtcgcggcgcgggcttcgggcccggacgcgggcccggggcggccggagccgcggcgggccgctcagccgctgcgggccgctcggccgcggcgggcttgggcgccggcggacggggggcggccggacgggccgcctgcgcgggagaaggcgcacccggcttggccggtgcggccttacggggggctgccttgccgccgttgccctgctgcagggcatcggtcagcttgcgtactacgggcgcctcgatcgtcgaggacgccgaacggacaaattcaccgagttcttggagcttggccatgacgaccttgctctccaccccgaactccttggcgagttcgtatacccggaccttagccacttcgctccttttaggtccgggttgcgtccggaccgtcgctacttcatgggcgtactcatcgcgtgctcatcgagtgctcatcgcaatctcgacctacttccaactcgcggaataccagggccgcacgggggttccgtacgacacgtcttacggtgttgcctgctcggcaacggtctgctcgacgtagtggcgcaacgccgctgtgtcgagcgctcccggggcgcgcaacgccctcgtgaacgcccggcggcggaccgccaggtccagacagaccagggcggggtgcacatacgcaccccggccgggcagcgtaccgcgatgatcggggacgcaatcaccctcgaccgccacgatgcgcagcagatccttcttggccgctcgctcccggcaccccacacaggtgcgctcagggcatgcgcgggcatgcgtccggccagacacggttaagtctacctccccgcaccgacctcacccctccggggcaagagtcgaacggttgttgtcgtgatctaagccacctgcggctgagatctattccccgatcccgcgaacggcctagtcgccgctctgctcggtgtccgggcggatgtcgatccgccacccggtgagccgggccgcgagccgggcgttctgcccttccttgccgatggccagcgacagctggtagtcggggaccgtcacgcgcgcggagcgggccgcgaggtcgacgacctcgaccttggagacccgggccggggacaacgcgttcgccaccatctcggccgggtcgtccgaccagtcgacgatgtcgatcttctcaccgttcagctcggccatcacgttgcgcacgcgaccgcccatggggccgatgcaggcgcccttggcgttcaggcccgatcgggtggagcggacggcgatcttggtgcggtggccggcctcgcgggcgatggcggagatctcgacggaaccgtcggcgatctccggcacctccagcgcgaagagcttcttcaccagattggggtgggtgcgggacagggtgacggacggaccgcgcacgcccttcgccacccggacgacgtacgagcgaaggcgcaagccgtgctggtacgtctcgccgggtacctgttcctgcacgggcaggatggcttccagcttgccgatgtcgacgagcacgttcttcgggtcgcggccctgctggaccacgcccgtcacgatgtcgccctcgcgcccggcgtactcgccgagcgtggcgtcgtcctccgcgtcccgcaggcgctgcaggatgacctgcttggcggtggtggcggcgatacggccgaagccggacggcgtgtcgtcgaactcgcgcgcctcctgcccctcctccaggtcctcggggtcctccttcgcccacaccgtcacgtggccggtttcccggttgagctccacgcgcgcgtggcggcggcttccctcggtacggtggtaggcgatgaggagggccgactcgatcgcctcgaccagcaggtcgaaggagatctccttctcccgcaccaagccccgcagggcgctcatgtcgatgtccacggctacgcctcctcttcttccgtcatgtccttcttgtccttgcggttgaactcgacctggacgcgggccttggcgatgtcctcgaaggcgagcctgcgggtggtggccttgcggcccttcactccgggcacctcgaggtcgaggccggcgtcgtccacggtcaggattctggcgaccagctcatcaccctcggtgagctggaatctcaccagacggtccacggcacgcacgtagtggcggtgctcggtgagggcgcgctccgcgcccggggtaccgacctcgagggtgtactccccctcgcccatcgcgtccgtctcgtcgagcttcgccgagagcgcgcggctcacatcggcgatcgcgtcgaggtcggcgccctcgtcggaatcgacgacgacacgcagcacacgcttgcgtccgacggattccacctcgatcccttcgagatcgaggccctgggagcccacgagcggttccagaagttctcgcagcctctcgctctgggtggtgctcatccgggtgactcctcggccgcgtgtgctgttgtgggtaggtcgtgtgtcaggtcaaagggtatccggtcgcggagggtgttgccgtccacccgcaccgccgttcggacggacgtgcggtgggcccgagccgctggcgggtgccggggcggggcccgggtaccgtgatcacgagcagggcctgtccggcggatcgagccggagaagagcgacggtgaccgacgagcgcgggtgagtgggatccggcgcgtgcggctgcgaggcggaggaggacgtcgtggcggggccacggcgaccgacgacaacgccgcagaggtgcgtgccggcccccgcggccccggcaggatccgccggacaggccctgggccgcccatccgttcgtacgagcccttcgaggacgtctgccgtgccgttcaccctgccgccgcgcatcccgccggggccgcgccgaaggagcctgctcgcttcggccgcgggcgccgcgctgctcgtcggctgctccgaaagccccgactcggccaacacggccggcagcccctccgccgccgaccgggcacgcgcgcgtgccgcccgggacagcgcggcgctggccacgcggtacgcggctgtgatcgccgcgcatccggcgctggcggaccttctgcgcccgctccggaccgcggtcgtacggcatacggaggcgttcgggggcagcgctcaggcatccgcgtccgcttcggcttcggcatccgtttcggcttcggccgacggtgacggtcgggcgcccgcgtccgcccacccctccgcgagcgcctcccccgccgtggccgccgaccggaagacggccctgtccgacctggccgccgccgagcgcgccctggccgaccggcgcacgaaggcgctgctggagttgccgggagagctggcgcggctcatggcgtccgttgcggcggcgggcgccgcgcacgcgttcttgctgacggagggcgcgaagtgagcgcgagcaccggcacgaccggcacaccgaaggccgagagcaccgagagcgccgagctgagggcgctccaggcggccctcggggccgaacacgccgccgtctacgggtacggcgtcgtcggcgggaagatcgggcaggcgcggcgggccgacgcgcgggccgcgtacgacgcgcaccgggcgcgccgggacgagctcgcgcggtccgtgcgtgacctgggcgggacgccgcaggccgccgcggccgggtacgcgctgccgttcgccgtgccggatgcgacggccgccgtacggctcgccgccgagctggaggaacgggtggccggggtgtactccgatctcgtacgggccggcacgggcgcgcgacgccgctcggccgccgaggcgctgcgggaggcggcggtgcgggcggtgcgctggagcggcgagagcgtagccttccctggtctcgccgagcgggcggcggccacccccaccgcgtcggcgacaccacagacgtaaggcgtacgccgtacgggtactcgggacgagtcgcgtacggcgtacgaagccgacctggaagggaacacctcgcgcatggctttcgaaccgccgcaacgcctcgtgcgggcgctcggcgagaccgagcggaacggggccgccgactggctggtcaagctgcccgagctggttcaacaggtcgttgatctacgcgagttgaccgtcgagcgggtgcaggcgccgggcgggcgcagcagcctggtcgtgctggtgcggcaggccgacggcacgcccgccgtgctgaaactcgcgccgccgtgggcccggcccgagagcgagcgggccgcgctggcgcactggggcggcttcggcgccgtacagctgctcgacggcgacggcggcgagggtgtgctgctcctggagcggctgcacccggagatgtccgtacggtccctgccggaggcgaaggccttgctggaggcggccggaaccctgcggcggctgtgggtcgagccgccggccggtcaggtcttcgagagcgtggccgagcggaccgggcggcaggccgaggcgatgcggacgagcgcggccgccgacgccgaggtcgcaccgctggtcgacgcggccctcgcggcccgcgaggaactgctggcctccgccccgcaggcgcgtctgctgcacggcaccttccggcagagcaaggtgctggccggtgagcggatgccgtggctggccgtggggcccgacccggtggtcggcgagtgcgccttcgacctggcccggctggtccgggaccgggtggaggacctgatcgcgtcgccctcgggggcctcgatcacccggcgccgggtgaagcggctcgcggagtcgctggagctcgaccaggaacgactgcgcggctggacgctgttccgtgccgtcgagtcgggggtgcgggcacgcagggtgggccgtccccaggacgcggaactgctgctggagttcgcgggctggctctgagcgggggtgcgtgcgaggcccggtaccgggcggtcggccaccgcgcgccgggcccgttcgaggaccgcgagcgggtccgggcccggaccgaggagccggtgaccccgttggtcgagcgtgccgtgccggcgcgaccgccgctgcggccccgtacgccgtgcgcctctgcgggccgcttctgcggcccccgctccttggccggcctgaccgtcccctccacctgacgtgttgtcacgtcctacgggcgggaagcggcctggggaagacagtgaggcgcccctgtgccggaaacaacttcccgaggggcgccttccgtcggacgatcacgccgacaggcgggcgatcgcctcctcgaccgtcagctcctcgcgctcgccggtcttgcggtccttgagctccaggacgccctcggccgagcggcgcccggcgaccaggatctgcggtacgccgatcagctcggcgtcggtgaacttcacgccgggcgagacgcccgcacggtcgtccaccagcacccgtacaccggccgcgcccagcttctcggcgacgtcgagcgccagctcggtctgcagggccttgcccgcggcgaccacgtggacgtcggccggggcgatctccttgggccagcacaggccctgctcgtcggccgtctgctcggcgagggcggcgacggcgcgggagacgccgatgccgtaggagcccatggtgacgcggaccggcttgccctccttgccgaggacgtcgagctggaaggcgtcggcgtacttgcggccgagctggaagatgtggccgatctcgatggcgcggtcgagcctgaggcccgtgccgcaggaggggcaggggtcgccctcctcgaccacgacgacgtcgaggtagtcgtcgacctcgaagtcacggccggcgacgacgttcttcgcatgcgtgttgatcttgtttgcgccggtgatccaggccgtgccgggggccacgcgggggtcggcgatgtagcggaccttctccaggccctgcgggcccacgtagccgcgtacgaggtcgtcgcggccctcgaagtcctcggccgtcaccagttccacgacggcgggcgcgaggtgctcgcccagcttgccgaggtcgacctcgcggtcgccggggacgccgacggcgacgatctcgccgtcggccttcaccaggaggttcttcagggtcgccgaggccgggacgccgaggtactcggcgagggactcgatggtcggggtgtcgggggtgtccagctcctcgaccgccgggtgctcgacgctctcgacggccggggcgacgaacgtgacggcctcggtgttggcggcgtagtcgcaggccgggcagtccacgaaggtgtcctcgccggcgggggccggagcgaggaactcctcggacgccgagccgcccatcgcgccggagacggcggagacgatccggtggtcgaggccgaggcggttgaagatcttgatgtacgcctcgcggtgcagcgcgtacgactgcgccaggccctcgtcggccgtgtcgaaggagtaggagtccttcatcaggaactcgcggccgcgcaggatgccggcgcgcgggcgggcctcgtcgcggtacttcgcctggatctggtagaggatcaccggcaggtccttgtaggacgagcactggtccttgaccagctgggtgaagatctcctcgtgggtggggccgaggaggtactcggcgcccttgcggtccttgaggcggaacagctcggggccgtactcctcccagcggccggtcgcctcgtagggctccttgggcagcagggccgggagcaggacctcctggccgcccatggcgtccatctcctcgcggaccacgcgggcgacgttctccaggaccttcttgcccagcggcagccaggaccagatgccggccgcggtgcggcgcacgtagtcggcgcgcaccagcagcttgtggttgagcgtctcggcgtccgccgggtcgtcacgcagtgtcttgaccatcaaacgggacatgcgctggacctgggccatgattcgactcctgctgcgaaagggtgatggcaaggaggttagccggggggccgccgtcgccggaaatccgtatccgccgaaaaggccccttgagcgtgcgccgcggacaggtgtcagcggcgccgcaggggcaggggggcgcccatgacggcgtacggccgcggcgcgctggggaacaggacctgccgcgccaggtcctcgtagccgagcgagtggtacagcccgcgggcggggctctcggtgtcgatcgcggagaggatcgagcggggctcggcggcgccgtccgtgatggtggtgatcagggagcggccgatgccgtggttctggaagtgcgggtggacgtgcagctcggtgatcacgaaggagttgtcgagccagtcctcgtggccctggccgcgcagatagggctcgacgacggtggaccaccagtgcgtacggtcgttcggcatcccgtagacgaagccgacgagccgtccgtcgccggtggtggcgccgaacgcgcgggctcccggggaggtcaggtgccgcaggacgatctggtgtcgtacggcgacctcgtcggcgccgagcccgaaggccaccgcctgtacggcgagcgcctcgtcgacgcgcgcggcgagatccaggaggccgatgaccacgtcgtcggggttgtggtggccctgaccgggaaagcgcagcatgccggcgagactaccggggcgcttcgctggatggtgccggggactgcgggttgttggtctgctgcgggacagtcgtggctggtcgcgcccgcgcggcggagccgcacgatgtcaccgccccgcgcccctgacggggcggccctgatgaggcccggtcctagaacagaacgctcatgaacgcgccgacctcttggaagcccactcttcggtacgcggcccgggcgggggtgttgaagtcgttgacgtagaggctgacgaccggggcgacatcggcgagggcgtagcgcaggacggccgccatgccgggggccgcgagtccctggccccggtattcgggggcgacccagacgccctggatctggcaggcgtggtgggtcgcggcgccgatctcggccttgaaggcgaccttgccgttgcggtcgaggcgggcgaacgagcgtccggagccgacgagttcggcgaccctggcctgatagaggaggccgccgtcgccggcgagcggggagacaccgacctcctcggtgaacatcgccacgcacgccggcatgatcgtctccatctcgtccttgcggatgcggcggacgtacggatcgggggcgacgtcgtcgggcagccggtcggtgaccatgagcggctgatgggcgcggacctcgcgggccgggccccagccgggttcgagcagctgccagagctgggtggtgggttcgacggggccgacgatggaggagcagcggcggccggccctgcgggcacggtcggcgaaggcgcggacggcccgcggggtggcgcagatggggaccaggttggcgcccgcgtagcacagggacgtgagcatgccgtcctcgtaccagccccacatctcaccgccgaggcgccaggggtcgaggcccgcgacctgtacccgggaggtcacgaaggcgttcgcgaccggctcgcggtcgagtacggcgagcgcggcgtccaggtcactcggttcgaggacccgggtggtggtctgcgtcaacacgtgcgggggcctcaccctggggtctgctgatctccgcactgtacctggcggaaatgggcgacgccgcccgatgtcatggggctctggtcactccatgttcgaggcgcttccctcgaacaaccacgccccgccacaaccagtgtgacggggcgcaggtggcgtacgtacgcgagggcgcggctctcagccggccaccgacaccgagggctcgccggaggcgatgccgtccgcctccatctgctcggcgatcttcatcgcctcctcgatcagggtctccacgatcttcgactcgggcaccgtcttgatgatttcgcccttcacgaagatctgtcccttgccgttgccggaggcgacgccgaggtcggcctcgcgggcctcccccggcccgttgacgacgcagcccatgaccgcgacgcgcaggggcacctccatgccctccagacccgccgtgacctcctcggccagcttgtagacgtcgacctgggcgcgtccgcaggacgggcaggagacgatctccaggccgcgctggcgcaggttcagcgactccaggatctggatgccgaccttgatctcctcgacggggggcgcgctcagcgagacgcggatcgtgtcgccgatgccctcgctgagcagcgcgccgaaggcgacggccgacttgatcgtgccctggaaggcggggccggcctcggtcacgccgaggtgcagcgggtagtcgcactgcgccgccagctggcggtacgcgttgaccatgaccaccgggtcgttgtgcttgaccgagatcttgatgtcccggaagtcgtgctcctcgaagagcgacgcctcccacagcgccgactcgacgagcgcctcgggggtggccttgccgtacttctccagcagccgccggtcgagcgagcccgcgttgacgccgatgcggatcggcgtgccgtgctccttcgccgccttggcgatctccttgaccttgtcgtcgaactgcttgatgttgcccgggttcacccggaccgccgcgcagcccgcctcgatcgccgcgaacacgtacttcggctggaagtggatgtccgcgatcacggggatctgcgacttgcgggcgatgaccgcgagggcgtccgcgtcgtcctgcgtggggcaggccacacggacgatctggcagccggacgccgtgagctcggcgatctgctggagcgtggcgccgatgtcggacgtacgcgtcgtcgtcatcgactgcaccgagacgggtgcgtctccgcccacggccacggttccgacctggatctgccggctcttccggcgctcggcgagcttggtcggaacggacggcatgccgagagaaatcgcagtcatctgctgtgcaaccccaagttgtggatcaaggtccggtagccggaacggcgggctccagccttcgagattacggcacgggcgtacgccggagcacatcacgctcccaaacccactcaatggaagacggtcggacacagagcgtgcccgaccgtcacgaaatccgggtgactaggagattttcaccgggttaaccacgtccgcgatcaggaccaggatcgtgaagcagacgaagatcccggccaccacgtacgcgacgggcatcagcttcgccacgtcgaacgggcccgggtccgggcgtcgcagcaccttcgccgcgttccggcgcagcgactcccacagggcgcccgcgatgtggccgccgtcgagcgggagcagcgggagcatgttgaacaggaacagcgagaggttgaagcccgcgacgagcatcagcatcatcgcgatctgctgggacggcgggatgtccagggtgaagacgtcgccgccgacgcgggccgcgccgaccacgcccatcggcgagtccgcctcgcgcgggccgtcgccgaaggccgcgtcccacagggcggggatcttgcccggcagggagatcagcgactcgacgccgttctgcatcatgtcgcccatacgggtcacggactgcccgaacgactgctcgacgatgccggaggcgggcgtgaagccgaggaagccggcgtacacgtacttgccctcgacgtagccgccgttgccgtcggtcttgctgacctggttcttgatcaggtgggccttgaggtcgagctgctgccccttgcgctccaccgtgatcgtgacgtccttgccggggttggcgcggatgtcggactggagggccgaccagtccgcgacggccttgccgtcgaacgcgacgatcttgtcgccgcccttgagcccggcggccttcgcgggcgcggcctggtcgctccgcgcgcacttcgtccggttctcgctctgctggatgacgcagtccgagaccttgccgaccgtggtggtctgggtgttgacgccgaaggtcatcatcacgccgaagaagatcaccacggcgaggatcaggttcatgaaggggcccgcgaacatcacgatcacgcgcttccacggcttgcgcgtgtagaagagacggtcctcgtcgccgggcctcagctcctcgaacgcggccgagcgggcgtcctcgatcatgccgcggaacggggaggtcgagcgggcctcgatctttccgtcggatcccggcgggaacatgccgatcatgcggatgtagccgccgagcggcaccgccttgaccccgtactcggtctcgcccttcttccgcgaccagacggtcgggccgaacccgaccatgtactgcgggacgcggatgccgaagagcttggccgtcgacagatggcccagctcgtgccaggcgatcgagatgagcaggccgatcgcgaagacgactatgccgaggatgaacatcagggtcgtcatgcacgagcctccgcggtcgccgtctgaactgtcagttccctggcccgggcacgcgcccaggtctccgcttcgaggacgtccgcgacggtcagggaagttcccgtgcgcggcgtgccgtgttcctcgaccactctcgtgacggtctccatgatcccgttgaacggcagcgtgccgttcaggaacgcgtcgacgcactcctcgttggcggcattgaacaccgccggggccgtgcccgcgagctgtcccacgtgccgggcgagtccgaccgaggggaaggcgtcgttgtcgagcgggaagaactcccagctcgacgccttcgtccagtcgaaggcgggcgccgcgtcgggcacgcgctcgggccagccgagcccgatggcgatcggcccgcgcatgtccgggggcgtcgcctgggccagtgtcgatccatccgtgaactcaaccatcgagtggacatacgactggggatgcacgaccacctcaatccgctcgaagggaatgtcgtagaggaggtgcgcctcgatgacttcgagtcccttgttgaccagggtcgcggagttgatcgtgatgaccggtcccatggcccaggtggggtgggccagggcgtgctcgggcgagacgttcgccagctcggccttcgtacgcccccggaaggggccgccggaggcggtgacgacgagcttgcgcacatcggcccgcgtcccggcggcgagggcctggaagagggcggcgtgctcggagtcgacgggaatgatctggccgggcttggccagcgccttcaccagcgggccgccgacgatgagcgactccttgttggcgagcgcgagcgtccggcccgcctccagggcggccagggtgggggccaggccgatggagccggtgatcccgttcaggacggtgtggcagtcggaggcggccagctgggtggcggcgtccgcccccgcgaggatctcggggagcggctcgccggggccgtactgcgcggtgagcgcttcgcgcagcaccggtacgacgtcctcgcgggcgaccgcgacggtgctcacgcgcaggcggtgggcctgttcggcgagcagtccgacccgtccgccggcggcggagagcccggtgacacggaaccggtcggggttgcgcagcacgaggtcgatggcctgggtgccgatcgagccggtggaaccgaggatcacgacatcccggactccgtccacggggtcgaagacgagatgcgggtcggcgaggggggctggactgtcggtcatccctccattgttgccgtaacgcgccacgggcaggacagggcgtccccgtcgagagtccgtctatcactccgatgtgcagagtgcggcgaaatccgcctttgtgaaacagcggtgaagatcacgtgatagcactgtcaggcactggccggcggacgaccggccggcggacgacaccctggggggacctccatgcggatacgcgctgccctgcccgcgctcgcgggcgccgtggcactcaccggcaccattctcagcactccggccgaagcggccggcggtgtgaccatccatcacgtctggttcgacagcccgggctccgacacccgctccaacgcgagcctcaacgccgagtgggtgcagatcaagaacaccggctccgccacggtctcgctgaagggctgggtcctcaaggacgtctcgaaccacaagtacgtcttcccggacgtcgcgatcggcgcgggcaagaccgtgaaggtgcgcaccggcaagggcaccgacaccacctcgaccaagtaccagagccgcggcgcgtacgtctggaacaacaccagcgacaccgccacgctcaccaaggcgagcgggaccaaggtcgactcgtgtgcgtggacgacacgggacccgagcgacacgtactgctgacgggggctacctcttgcgccgccgccggttccgggacttcccgggccggtgcggcggcgctttgtcgtgctcggccggttccccggcgggcgccgtcgtgaagcggccctcgaccacgccctccgcggtgtccagcgtcggcgcgctgaagtgcagtccgtcggtggggcggcggtccagggcggagccctccccctcccggcccgtggcgtccaggttgaacacgtatccgacggactcctccttgatcgcctcggtcatcgcgccgaacatgtcgaagccctcgcgctcgtactcgacgatcggctcgcggcccagcgtccagcgcaggccgatgccgtcgcgcaggtagtccatctcgtagaggtgctcgcgccatttgcggtcgaggacggagagcacgacgaggcgttccaggtcgcgcagggcgtcggcgccgagttccgcctcgcgccgcgcgtagcggtcgtggacgtcctcggtgaccgccgccacgaggtcgtcgactgtgaggtcgggccggccgccgacggagtcctccaggtcctcgatggtgatgccgaccgggtagagctgcctgaaggctccccacagccgctccaggtcccactcctcggggaagccctcgccggtctcctgccggatgtacgcctcgatggtgtcgtccatgaagtgccggacctgctcgcgcaggtcctcaccggccaggacgcggcggcgctcggcgtagatcagggtgcgctggcggttgaggacctcgtcgaacttcaggacgtccttgcgggactcgaagtgctgctgttccagctgggactgggcggaggcgatggcgcgggtgaccatcttgttctcgatcgggacgtcgtcgggcacgttcgccatcgacatcacccgctcgacgacctgggcgcggaacagccgcatcaggtcgtccccgagggagaggtagaagcgggaggcgccggggtcgccctgccggccggagcggccgcgcagctggttgtcgatgcggcgcgactcatggcgctcggtgcccaggacgtagaggccgccgagttccttgacctcctcgtgctcggcggcggccgccctgccgacgcggtcgagtacggcctcgcggtcctccggcgtggcgtcttcggggagcgcggcgagcgccatcgcctcggggttgccgccgagcatgatgtcggtgccgcggccggccatgttggtggcgacggtgacggcgcccctgcggccggcctgggcgacgatctgggcctcgcgctggtggttcttggcgttgaggacctcgtgccggatgccctgcttccgcagcaggccggacagcagctcggacttctccacggaggtggtgccgacgaggatcggctggccggtctcgtgccgttcggcgatgtcggcgaggatcgcggcgtacttcgcctcctcggtgcggtagatctggtcggggtcgtcgcggcggatcatgggccggttgctcgggatcggcacgacgttcaactggtagatctggtggaactcggcggcctcggtcatcgccgtgccggtcatgcccgcgagtttctcgtagaggcggaagaagttctgcagggtgatcgtggccagggtctggttctcgttcctgaccgtcactcccgcctccgtgccctcctccgcctccttcgcctcgatcgcctggtgcagcccctcgttgtagcggcggccggccaggatgcggcccgtgtgctcgtcgacgatcagtacctcgccgtccacgacgacgtagtccttgtccttcctgaagtgctccttggccttgagggcgttgttgagatgcccgatcagcgaggtgtgctcggactcgtacaggctctcgatgccgagctggtcctggaggtactcgacaccgcggtccaggatcgccacggtgcgcttcttcgggtcgtactcgtagtcgtgggtggtccgcagatgggcgaggcggtccttgtcggccggggtgacgaactgctcctcctggacccgtacgccccgcatccgcgtgaccagcttggcgaaggccccgtaccactgggtgggctggtcggccgggcccgagatgatcaggggcgtgcgggcctcgtcgatgaggatcgagtcggcctcgtcgacgatggcgaagtggtggccgcgctggacgagttcgtcctgcgaccaggccatgttgtcgcgcagatagtcgaagccgaactcggtgttggtgccgtaggtgatgtcgcaggcgtactgcgcgcgccgctcggcgggcgtcgactgtgacttgatgacgccgacggtcaggcccaggaagcggtacgcccgtcccatccactcggcgtcgcgctcggcgaggtagtcgttgaccgtgacgaggtggacccccttgccggtcagggcgttcagatagacgggcagggtgccgaccagggttttgccctcgccggtctgcatctccgcgatgttgccgaagtggagcgccgcgccgcccatgagctggacgtcgaagtgacgcatgccgagggtgcgccgggccgcctcgcgcatcgtggcgaaggcctcgggcagcaggtcgtcgaggctctcgccgtcggcgtggcgccgggtgaactcgggagtgagtgcctggagttcctcgtcggtcagcgccttgaattcttcctccagggagttcacctgtgccgcgatgcgctgcaaacggcgcaggattcgcccttcaccggcccgcatgatcctgccggtgatgttgtcgagaccgagaaccggcatcggaattacccccactgaccactcatgaccgctcgataagcgctcgataatcacccggcaaccgctcgacaaacgctcgacaaacgctggacaagctctagatcgagtccgccagcatccggatccagtggttggcccgctggagaatgtggacgccctgctgattcgccttgatcacctcgcgcagtaccgggtccttcgcgtacgccacggagccgcggaacagctgctggatgacgggccgttcgcccggccggcccgcgtccagcagggcgtcgacgtcccgcaggtcgatccgccgcaccggcatcgggtcgaaggtggcgacgggcggcctcggttcctcgtcgaccagggcgagcgcgcagtcgttcaggaggacggcgagcgcgtcccggtgcgcctcgaaggtctccggtgccgtctggcgcagtttctccgccaggggcacgacctcgttgcgcacggtccgcagggcctttaccagatctgtcgcgtcgagctggtggcgcgcgtccccccgggcacgcgtcagctgtacggaaattccatgactgtgttcttccccgacaccttggcgcatctgctgtccccgttcgccattctgctcattgttgacgcacaactccggtgcggcaagcggcagaatgacggacgggacgacagttcacgggcggggaaaaggtcagcgaatggggcggtggacgttttcccgtttcgccgctcccggggtcgcgtccgcgatccacgggccttcgccggacgggtcgatgaccccttcctccagccatgcgtaggtgcccgacaggacgccctcgaccaccttgcggtcgaggtcgtcggtgttggaccacagacggccgaagagctcctcgacgcggatccgggactggcggcagaaggcgtcggcgagctggtacgcctcgcggccgtggtccccctccttgcgcaggagttcggcgcgtacgcacgccgcgctcatcgcgaagagttccgcgccgatgtcgacgatccgaccgaggaagccctgtttggtctccatacggccctgccagcgcgacatggcgtagaaggtggagcgggccagcttgcgcgcgccgcgttcgacgtagcgcagatgcggcgacaggtcgacctcgcggcggaactcgccgtacgcacccgggatctgcccctgtcccgcgaccagcttcggcagccacttggcgtagaacaccccggcgttcgcgccggccttcgccttgtcggacagggacttgtccgggtcgatcagatcgccggccaccgagagatgggcgtccacggcctcgcgggcgatcagcagatgcatgatctccgtcgagccctcgaagatgcggttgatgcgcaggtcgcgcaggatctgctcggcggggaccgcgcgctcgccccgggccgcgagcgactcggcggtctcgaagccgcggccgccgcggatctggaccagttcgtcggccatcaggcagcccatctcggagccgtacagcttggcgagggccgcctcgatgcggatgtcgttgcggttctcgtccgccatctgcgaggacaggtcgacgacggcctccagcgcgaacgtcgtcgccgcgatgaaggagatcttcgcgccgaccgcctcgtggaaggccaccggcttgccccactgctcgcgcgccgccgaccactcgcgggcgatcttcagacaccacttgccggcgccgacgcacatcgcgggcagggagagacggccggtgttcagcgtggtcagggcgatcttcaggcccgcgccttccgggccgatgcggttcgcggccgggacgcggacctggtggaagcgggtgacgccgttctcgaggccgcgcaggcccatgaacgcgttgcggttctcgaccgtgatgccctcggacccggcctcgacgacgaaggcggtgatgccgcccttgtggccctcggacttcggtacgcgggccatgacgacgagcaggtcggcgaccacgccgttcgtggtccacagcttcactccgtcgagcacgtagtcgtcaccgtccgggaccgcggtggtcgcgagccgcgccgggtcggagcccacgtccggctcggtcagcaggaaggcggagatgtcggtgcgggcgcagcgcggcaggtacgtgtccttctgctcctgggtgccgaagagtttcagcggctgcggtactccgatcgactgatgcgcggacagcagcgcgccgagcgccgggttcgccgagccgaccagggcgagcgccttgttgtagtacacctgcgtgaggccgaggccgccgtacttggtgtcgatcttcatgccgagggcgccgagctccttgagcccgttgacggtctcgtcggggatccgcgcctcgcgctcgatccgggccgagtcgatctccgtctcgcagaagtcgcgcagcttggcgaggaactcctcgccgcgctgcgcgtcctcgtcggcgggcatcgggtgcggatggatcaggtcgagccggaagcggccgaggaacagctccttggcgaagctgggcttgcgccagtcctgttcacgcgcggcctcggcgacctgacgcgcctcacgttcagtgaccgttggctggtggggtgtggcggacatgaggctcacctcgccgcgaatagggatcttgggcgtgttcgttaccgaccggtgctactcgatcgtatgtacccgattacgggctgccccaccagtcttcgcgcagcgttcgccggatgcgcgccgactacgccagtcagccgatgtccaccgagtacgccttggtgtccagtcggcccgcgcccttgaagacctcggtgcccgcctcgatgccggagacgtacttgtcgtcgctcagcagcttgcggcggaccagggcctgggtgaagtcgtccaggtcgagcgtggccttggtggtgttcgtacgccgtacgaaggagtacaccttccagccgatgtcgccctggtagatgtcccacatcgcgccgccgaggctgacgctgccgtacttggtgcccagcgggcccgcgccgccctggcggttgagccagaccatgatctcgtcggtgggctggtcctgccagtccgcgttgttcttggcgtgcagccacaggtcgtacgcgacgttcatcgtgccgggaccggcgccgaccgagaagtcccaggtggtcctcacgctcttgcggtcgcccacccggacgggcagacccgtcgccgccttgtccgccttccagccccagtgccagccgaggacactgctcgcgtaggacttcacgtcgtagtcgtgcccggcggagttgttggcccaggagtagtccgtgccccaggagatcgtggagccggaccgggagtcgtcccagacgcactgggtgccggtggccttgtcctggccccagaggttgttgttcacgtagtacttgccgagcgtgatcgtgtcgaaggccgcgcacttcttgccggtctcgcccgcctgggcgacggtgacgccggcggcggccgcgaggacgaccgtggtggcgaccagggccctcgccttcttggacaggcgcggtctgcgatgctgcatcaggggtccttccgggggacggtctgcttacgcccctcagtggccgccggatcttccggaggttgccacggccggcgtggaaattgtgcccggaattaattgtcgaagcgcttcgacagcctatggacagcccttcctcgccgagctactgtcgagccaccctcactccccttatccgcaatgcgcgcactgtcgaagcgcttcacacaagcttggagagctggatggtcaccctcgccgaggtcgcccagcacgccggagtctcggcgagcacggtgagctatgtcctcagcggcaagcggtccatctccgtgggcacccgccggcgggtcgagcagagcatccaggagctcggctaccacccgaacgcgggggcccgcgccctggcgagcagcaggtcgaacatcatcgcgctgatgatcccgctccgcacggacatgtacgtccccgtgatgatggagatcgccatcgcggtggcgaccagcgcccgcacccacgggtacgacgtgctgctgctcaccggcgaggagggtcccgacgcggtgcgccgggtcacgggcagcgggctcgccgacgcgatgatcctgatggacgtcgagctcgacgacgagcggctgccgctgctgcgcagcaccgaccagccgtccgtgctcatcggactgcccgccgacacctccggactgacctgcgtcgacctggacttcggcgcgacgggcgccctgtgcgccgggcatctggcgacgctcggccaccgtgacatcgctgtcatcggcgaggcgcccgcggtctacgaacggcacacgggcttcgccgagcgcaccctcgacgggctccgctcccgctcgcgggagctgggcctgcgcgtgctgcaccggccgtgcgagggcggctacgacgcgatggccctgacgctcgcccggatcttcgacgagcgcccgagcaccacggggttcgtcgtgcagaacgagtccgccgtggaaccgctgctcgcgctgctgcgccggcagggacgggccgtacccgaggacgtctccgtgatcgccatctgcccggaccaggtcgccacgcaggcctcggtgcggctgacgtccgtggccatcccggcccaggagatgggacggcacgcggtggagcacctggtcgcgaagctgaacgggcacggcgaggacgaagtcgtgctgatcgcacccgagctgacggtacgggcgagcacgggaccggcaccgaccgccgcctgacccgccaccgccccgctcgaccgccgcgcctcacacccgaccgcctcctccctcacccaccgccgccccactcgaccgcgcgcccccacctgaccgcccgaccgccgcgcccccgcctgaccgccgcgtctccagcctgaccgccgcgtctccagcctgaccgccgcgccactccagggcacccccatgtctgcactcgttcaggagcactccacgtgaatcagcctgccgaaaaccagccccaggtcagccttgcccagtcctccccgaccgtcggcacgttccgcgagcgggacggcgcgctggagtggagcggccgcacggagaccgtgcgcgtcgagccctggggcccggacgcggtccgggtccgcacccggctcggcggcccggtcctggaggggctgccgggcgccctcctcgacgagcggccgtcgacgccgtacaccctcaagatcgaggacgggcgggggacgctgaccgtcggcgcgctgaccgtcgaggtcgacgccgagggcctgctccgcttcgtgcgcacggacgacggtggagaactcctcgccgaggagcgggcccacttctggtggccgggctcgcggctgtacaccccggccggcggcggccggcaccgcctggaacagcgcttcgccgcctacgagggtgagcggctgtacggcctgggccagcaccagcacgggctgttcgaccagaagggcgcggtgctcgacctggtgcagcgcaacgccgaggtgaccatcccggtgctgacctccagccgcggctacaccttcctgtggaacagcccggccatcggccgcgtggagctggcgggcaacggcacgcgctgggtggcggactcggcccggcagatcgactactggatcaccgcgggcgacccggccgacgcccagcgccgctacagcgcggtgaccggccgtacgccgatgctgccggagtgggcggccggcttctggcagtgcaagctgcgctaccgcacccaggacgaactcctcgcggtggcgcgggagtacaagcggcgcggcctgcccctcgacgtcattgtctgcgatttcttccactggacccacctgggcgagtggaagttcgacctcgatcagtggccggacccggcggcgatggtggcggagctggcggaactcggcgtcgaactggtggtgagcgtctggccgtcggtctcgccactgagcgagaaccaccagctcatggagcagcgcggctacttcatcggcaccgagtacggccccatggcccatgccgactggcccgacaagggagtcgcgtcgacggtccaggtggccttctacgacgccacgaaccccgaagcgcgcgagttcgtgtggtcgaaggtgcgggacaactacctgaagccgtacggcatcaggtcgttctggctggacgcctgcgagccggagctgaagccgggcttccaggagaacctgcgctactacgcggggcccggtccggagacgggcaacctgtatccgcgcgagaactcccgcaccttctacgagggcatgctcgccgccggcgagaccgaggtcgtcaccctcaaccgctcggcgtgggcgggcagtcagcgctacggcgccgccctgtggtccggcgacatcggcaccgacttcgcgactctgcgccgccagatcgcggccggtctcaacacggccctgtccggcatcccctggtggaacacggacatcggcggcttccacggcggtgacccggacgatccggcgtaccgcgaggtcatggtgcgctggttccagttcggcgcgctgtccccgctgatgcgcctgcacggcttccgcgacccgggcacgccgctcggacccgggatgaccggcggccccaacgaggtgtggtcgtacggcgaggaggccggcgcgatcctggagaagtacctgcggctgcgcgagcggctgaagccgtacgtcctcgacgtcatgcgcgccgcgcacgaggagggcctgcccgtgatgcggccgctgttcctggagttccccgaggaccgggccgcctggtcggtggacgacgcctatctcttcggacccgatctcctggtcgcgccggtcctcacggcgggcgcgacgtcccggaccgcgtacctcccggcgggcgcgtggtggacggacgcgtggacgggtcaggagtacgagggcggcacggccgtgaccgtcgacgctccgctggaccgcatcccgctgttcctgcgggacggggcgcggctgccggtggcggagtgacgcgtgtggccggtcccacggggggaccggccactccttcatgctctccgggggatcagctgctgctgacgctcagactgttggtggtgaagtccaggccgcccgacgaggacgtgatctcgaagccgaactgcacgtcaccgatggtcacattgccgaaccagcccttggtgtccttgatccacttcaggatcgggaggacgttcacggtgccggaggacgagtccgaggtgcgcaggaacgagaagacgtcgttcgagccgttgttgcccttgtagacggtccaggtgtgaccgcccagcgtcaggttgccctgggaggtgccgagcgcgccgacggctccgttgtagttcacccagagcatgacctcgtacttgtaggccgtgtcccagatgtcgtacgacgtgttgtacgcgccggaggacgggaccgtgacgttgtagctgctgctgagcgatccgagtgaggtgatcgacttgttgatcaccttcttggcgttcgggtaggacttgatgccgccagtgttcgggtggttggcgttgacgccccagttggtgccggagttggcccagatgcactggctgcccgcgccggagccccagatgttgttgtagagcgtgtagccgttcagggtcgtgttgccccactggtcgcaggagctccagaccgctgcctgggcgggggcggaggcgaggccgatggtcgcgccgagcgcgagcgcgggggcgatcagggctttggtgaccttgctgagcgtgcgtggtgccatggtgtcccttccatgggtggggggagtgcctggtgctactgcggccccagggtgaggacgcagtcctctccggcgacgagatcgaggggtcgtgcgccggaggaagtcctgaggtcgacgcgcagggtgcgcgtcgggcggatgacggccgtgcgctccccggggccccaggtcaggtcgacctcggcgccgaagcgggtgcggacgccgcgcaatcggcccgtcggatacgcggtcggcagggcgggaaagaggacgagccgcccgggcgtggactggatcagcgcctcgatgatcacggcgggcagcgtgtgggcggcgtccgcgttgtagacgtggcggttcgggtagtgcccgctcatcagggagacatggaagaagtccccggccagtacgttgccgagggcgcccgccacccggtcggcgtcgcgcagccgggccgcgatcagggcgtggtggaggtggccgtgcgcggagtcgttctcggcgccgcgcagttcgagggcgcgatgggcggcggcggcgagttcgggggtgtcgtacgggttgatctcgtcgaggggccagaccccgtagaggtggctcaggtgccggtggtcgtaggtgtcgtcgagaccgggccaggcccactcggcgagggcgccgtcggcgttgacgcggtgcgggggcagccggtcggcgagcgcgcgcaggcgctcggcgtcgggtcccgggtggtagtgggccgccgtgaggagggcgtgccgcgccgccgagaggtccatggcggcgttgagggtgatccagctcgcgttcgcgggacggttctccggggagtacgacggcacgacgacgagatgaccgttcttgtcggtccgggtgaggaagtcctcgtagaagtacgccacttcggcgagcgcgaccgccagccgcgggtcgcgcgccccgctcgtctcgtcatggtccacgaggggcttcaggagccagtcggcgcccgcggtccacacatgcagggggtactcgcggctgaggtggtagatgtgcccggactcaccgtcggtgtgcgcgggggcgacgacgccacgggtaccgaagatcgcccgggcgttgtcgcgccagtgcggcaactggccgtgcaccagggcggcatgagcctcggagacctccgggagggcggctgcggcggccgacgccgtctgcagattgacattggcgtcggtggtgaaggcccccgcccacgcggtgtcccagtccccggtccacaggccggtcagccgtgggggaagcatcccggcggaggacaggaggtggtagcggccggccgcgaagaggcgttcgaggagggcggggctcttcgggcggcggaccaactccgaaccagggagggcgcgttcggtggggtcggcgccgaggtccagacccgcgcggaggtaggcggtgcggtggagggcggtgtggcgggccaggaggtgggggtacgcgtcctcctcgtcaccgggcagcagggcgcgcagttccctggcctcggccaggacgtccagctccccggtgtgccgccgtacgcgggtgagcaggagcagcgaggccgccccctcgacccgcagaccgggcagcgccgtccgggtccggccgccgctcaccacggcgagcgtcacgcccgtgtacgccaggtcgccgccggggtagcgggcccgcagggtgaggagggcgccctcggaggtgaggacggcgccgtgccccaccgccaggtccctcggcgcgcccggcagccggtggtccagcgtcacgtcgagggtgaggccgggtccggtcacgcgctggaccacgacgtcgtcggcgcgggagacgaagacctcgctgcggccgccgccgtcggcgccgacgactccggtggtgaagtcgacatggcgccggtacgagcgccgctcgggggccgggcggcgcagccgtatccggaacgccgggtggaagggccgcacccacagcagcggccgaccgtcggtgaagtcctcgccggccgtggtgtcgcccgccagcaagcggtcctggaggccggggagccggtccgccagcgcgggcgggccggcgtccgcgctgccgttggggcggatcagggtgtgatgattgacgatgacacggtcatcgttcggatcaccgaacaccatgacgccatggcggccgttgccactcaggaaggcgtcctcccagcgggtggcgggggcggcctcccaggtgccgtgcacgggctcgctcatggcgccgcctccagtaccgccgcgccgtaccgccccagctccacggcatcgacgacgtcctcgccggtcagcaggtcgcggtggcgtccgggtaccggcacggtcaccgtgtcccgcccgtggtggagcaggaacagtagctcgccccggcgtaccgcctccacgcccgccgggaggtggtcgagcgccggccgtacgcccgcgtcctcggcgatcccggcgagcagcggccacagcgccgccggctcgggaagggtggacaggtaccaggcgcggcccttgcgcagtacggccggaagaccgtccagctcgccccccttgtaggggatgacggcgtaggcctcgtccgcggcctcgatctcctcggaccacagagtgccgcggaagccctctacgccgaccttctcgtcggcgtcgagcggccaccattcgtgcagggtgcggatgccgaagagcttccgcaaccgctcgtccatgccgccctggcgcacccggtcgtcctggtcggcgacgccggtcaggaagccggagaccacggtgccgccaccccgtacgtatgcgacgaggttgtcgatcgccgtgtccgtcaggagatacagctgcgggaggacgaccagcttgtacgcggacaggtcgtgctcggggtgggcgaaggaggcggtgacgttcgcttcccacagggcgcggtgccaggcgcgtacgaccgcggggtagtcgacctcgccggacagccgaccgtcctgcccgctcgcccaccaggcgttccagtcgagcagtacggcgacatcggcacccgtgacccgagtgtccgccaccttctcgctcagcagggcgagttccgccccgatgcgcttgacctcctggaaggtgcggccccgctcccccgcgtggctgaccattccggagtggaacttctcggcgccctgccgggactgtcgccactggaagtagcagacggcgtcggcgccgcgggccacggcctggagcgaccagagacggttgaggccgggcggcttggggtggttgaccccgcgccagttgaccgggcccgccgcctgctccatgaccatccaggggccgccgcgggcctgcgagcgggtcatgtcgtggatgagcgcaccgtactgaccgcccagcggatcgcgcgggtccggatagctgtcgaccgagacgacgtcctcccggccggcccacgcccaggcgtcctggccctgccagaacggcatgaagttgctggtcacggggatgttcggggtgtgccgggcgacgatgtcacgttcggcgacgaagcactccatgagtgcgtcggaggtgaagcgcttgaagtcgagcacctgggtggggttgttcatgtagtgggcgtggcgcggcgggaggatgccttcccagtcgtcgtagccctggctccagaaggccgtgccccaggccgtgttgagtgcgtcgagcgtgccgtacctgccctggagccagcggcggaaggcggtggccgcctcgtcgccccagtcgtaggtgcagtactcgttgttgatgtgccacatcgtgagggcgggatggccgccgtagcgggcggcgaggtcctcggtgatggcggcggcgtagcgccggtagacggcactggagtgggcgaagtgctggcggccgccccaccactcgatgcggccgtcctcgtcgcggggcagggtctcggggtgcaggcgccccatccagggcgggggcgaggcggtgggggtggccaggacgacgccgatgccgttctcgtgcatcaggtccatgagccggtcgagccagccgaactccctcgcccccggggtgggttcgagctcggcccaggagaagacgccgacggtgacggagttgacgccggcctccttcatgaggcgtacgtcctcctgccagacctcctcgggccactgctcggggttgtagtcgccaccgaacaggatgcggccccgggtggcatccgtgagcccgggcatcagaccggctccccgtactggatgccgcgcccgttggtggcgaggtagacccggccgtggatgcgcgggtcaccgacgacggcctcgccgatccacccccactggtgggcgtcgtcgttgatccggacccatgtcctggcggcgtcgtcggagcggtagacggcggtgatggtctccgtcgagccgacctggtagatcgccgggtagtcggcgccgtcggccgccttgccgaagccgagggtgtacgaggcccagcagctgtcgatcctggcgaaggtgtccccgccgtcggtggaccggtagagcccgttccatttggcggagagccacaggtcgccgcttcgtcccggcgccgcgaccagcttgaactggctgtcgccggagggcagtccgcccgcacgggccgtgaacgaacggccactgtcagtgctggcgtatagcgttccattgtcgaagtcgtaggcgtagaagcgcgtcggatcggccgggtcggcgaccggtgtggcgcccttcgggaaggaggagacctcggaccagctcgcgccgttgtccgtcgagcggtgggccgcgtacgtcgtgccgtcccagtgcacgaaggaccacagcagtgtgccgccgtcggcactggtggcgatcggtcccggtgcgtccttggcgatgtcgggctgggcctcgaagggcgcccaggtccgcccgccgtcgtgggagtacgcgccgttgccgtggtcgccccagcccgtgcggacgacatacgccggcctggccgcggcctgcgcgagtcccgtcgccgacccgaacacggggttcgtcgccatgccgcgcgacggagacgccgtgagccgctcgtggtacatcacaccgatgtccccgagtccgctgatcaggtgtgcctccccgaccgggggcgagatcagttggcgcacggcgctctcctccaggccgcggatccgcggtgcccagcgcttgaggtcgcgggtgccgtagagggtcgcgccggtcccgtacacgacgtgctgggagtcgtacgggtcgaccgcgagcgcctggatccaccagccgaacttcggcttgtcgtcgccccagtcgaggaagggagtctcggacacgtcgaacacggcggcgtccttgagggacgtccaggtacggccgccgtccgtggaccggaagaccgtgtcgccgtcggcccagcggttgttggtggagacgacgagggtgccggggcggcgggcgtcgacggcgaccccgccgtaggcgaaggtgtccgccgagccgtcgctcgtcgtcccgcccggcttcaccggggtgacctcggtccacgtccccgtggcggtacgcagcttgtgcacgctgccgtcggactggccgcccgggccgggtgcgtcgccgtacgtcacgtacagctcgcgggtgtgcgtgtcgtacgcggcgcggagcgggaccttggcggaggtgccggagggccggccggggacggccccccaggtcgtgccgtcggccgtgcggtacaggttcgccgtgcccgaggtgccgtcgccgtcaccccagccggcgtagacggtgcgcccggcggcgacgaggaacacgactccctgcccggaggagttcgccttcgccgggaaggcggtcgcggctgcccaagtggcgccccggtcggtcgacttgagcagcccgtcgtgccgcgtgcccagccagagggtgtcgctgtcgcgcgggtcgacgaggagtcgctcaccggcgccgcggccgtcctcgttgccgccgagcttcacggtcaggtcggtgcgggtccaggtggcgccgcggtcctcggagcgcaggaccgcgccgttgcccgcccacgactgggcgtaggtgcccacggcgaggtagagccggtccgggtgcgtggggtcgacggccatcgcctcgacgccgaggaggttccagtcgtcccagccgaggtggtcgatgagcggggtccagcgggcgccgcggtcgtcccagcggtaggcgccgccgatgtcggtccgggcgtaggcgagaccgcgtacggaggggtggaagagcacgccggtgacgaagccggtgcccccgatgacggcgttgcgccagcggtacgacgggccggcggtggtttcggcggcgtgcgcctgggaccccacggcggggacggccgtgagcgcggcggccgcggcggtcccggcgaggacggttcgtctgctcgggcggggcgtgcgcatgacatacctcgttctgggagaggggagttctggagaggcggggggagcgccccttctctcaggggctcgaggctgtgacatcgtgcggctccgccgcgtgggcgcgaccagccacccactgcccgcggtgaacggacgccccgcggctccccggcacttccaaccgggcgtcagcccttcaccgcgccggtcagcatgcccttcttgaagtgccgctggacgaagggcgagagaacggcgaccggcagcagggccagcaccatgacggccatctggacggcgagtgcggacacctggcccgtcttgatggcctggcccatgccgaccggtggctcctgcttctggacgagctggatcatgacgttctgcagcggcatcatgtcctggtcgctcaggtagatcgacgcgttgaaccaggcgctccagtagccgacggcgtagaagagcgtgatcacggcgatgaccgcgcgggacagcggcatcacgatctgccagaggatccgccagtcccccgcgccgtcgatccgcgcgctgtcgacgagctcctgcgagatacccatgaagaacccgcgcagcaccaggatgttgaagacactgatggcgctcggcaggatgagcgcgagatacgtgtccgtcaggcccaacgactgcaccagcagatacgtggggatgaggcctgcgccgaagaacatcgtggcgagcagggtcatcaggaaccagcggtgcccgaccgacccgatgcgggacagcccgtacgccgctaggacggacaccgtcatcgagaacagcgtgccgacgagggtgacgcccaggctgacgagggtggcgcaggtgacctgaccgccgctcagcagctcctggtaggcaatgaagctgatgcccttggggatgaccaccaggccgccggcgtcggagatgaccttcttcgaggacaggctggtgacgatgacgatccacagcgggaacaggacgccgaggcaggcaccggccagggcaatgcccttgcccgcgagcccggccttgccgggctcctcctcccagacgggcctcggcggggcggcccagcggccgggggccttcggccgttgttcggtcacggtgctcacttcttgtacaccccctgctcgcccatgagatgggcgaccttgttcgcggcgaggacaaggccgaggctgaccacgcccttgatcaggcccgccgccgccgcgtaactgaagtcctggttacggacgccgttccaccacacgaaggtgtcgaggacgtccgacgcgcccggcccgaccgcgtcgcgttgcagcaggatctgctcgaagccgaccgtgagcgcgtcaccgacgcgcagcaccagcagcagggcgatcaccgggcgcagcgcgggcagcgtgacgtgccacatccggcgccatcgcccggccccgtccatcgccgcggcctcgtacaggtcgggactgacggaagccagcgcggcgaggaagacgatgatgccccagcccgcgtctttccagactccctcggacgtcaccaggaatttgaagatccccgggtcggtcatgaggtcgaagccctcatacccgtgctgccgcagggtctgcgcgatgatgccggcgccaccgaagatctgctggaagacggtgatgaccagcacccaggagaagaagtgcggcaggtagaggatcgcctgcgacaccgcccgcacccggggcctgatcacgctgttgatgagcagcgcgagcaggatcgggatggggaagaagagcaacagctggagggagaacaggacgaaggtgttctggacggcgttccagaacgccgagtcatcgaggatccgggtgaactgctcgaagcccacccaggggctctcgaagatggcgacgaagccgttgtcgctgatgtacgggtcgtactcctggaaggcgacgacgttgcccaggatcggtatgtagttgaagaccaggaccagcaggacggccggcagggtcatcaggatcagcgtgcggtcccgcttgagacgggtcctgagagtgccgccctccgaggccttcttcaaggctttcttcgacgccttggagacagcggcgggcctggcggccttggcggacccgctcccgccgtcggacggctcggcggtgtccgtcgccgaggacggatcggtgcgcgcggcggcgcccggcgtggtgctgtgtgccacgtcgtcacccctgcgcggatccgctgtcgtccagcagcttcttgtaccagtcccgcagcttgtcgccgccctggctcttccagtccgacaccgcctgctgcatgtcgctgatcttcttgcggccgcggacgacgtcgtcctccagatcctcgaagtcgttggagaggttggtgtagcgagccggttcggtgacctggagtccgaagaaggaggacttcttggtgaaggcgcccatccgctgctgccactccacctgttccttggcgatgtccgggaagtcggggtgcgcgatggtcggggcggggctggcgagcatgacgtaggcgttcaggacctccaagttgccctggtcggtcttgaccggcatgccgtccttgacggtgtagtgcgtgccctccaccccgtagttggtgagcatgtactccttggtgccgtacggggcggcggtgacgttcgcggcggccagcacatcgtggatcacggccttcgacgccttcttgttgatgaaggcgaagatgcccgcgggcgacccgcaccacaactggggatcgcccccgtcgtggccgaagatgtccatgcccgcgatgcggaagtccttgttctgggtggcctgttcggccatcttgccccaccagtccgagatgttctggttgtacatcaggacctggccgtcggtgaaacgctggcccgcgttgccctggttcttcgccttggcatcggggtggacgacacccgcggcgtacagcttgcgcgtccactccagcgcttcgaggtactcgtcggtctcgacgcggtagatcagtttgccgtcgacgaggttccagccgagcggcttctcgcttccggagagcacaccgaagatgccgaaggccgtccacttcatgtcgtcgcaggcccacaccttcgccttggcgtcggtgatctccttggcgagggccaggaacgcgtcggcggtggtggggagttcgtaccccttgtcgtcgaagacgtccttgcggtagaagggcacgatgcccgggacggtgggcgcgggctggggcaggccgcgcagcttgccgccgaagatggagtactgccaggcgtcgctcgggatggcggcgaggttcgggtagtccttgatcttgtcgccggagaggtacgggccgaggtcggccatcttgctgatgatggcgctgggtatcttgccgcccatgttccaactggggatcaccacgacgtccggcatgtcgctggaggcgaggaccgcgcccagcttctcgtcgtacgtgttgccgtcctggttctgccagacgatgttggcgccgatcttcgcgttcatcgccgagtagtaggggttgctgctcttcggcggcgagccccagaacggtgacatgatcttgatggtgctgcccttgccgagcttccgaggcactgaggtcttcaggtctgcgagcgaaagctcgctggtgaagccgagggcggagccgttcttcgacgcgatgtccggcgtcaccacgttctgcgccacgaaggcgggaaggatcttctgcgcacccttgcccgaggtcgtgccctccttggagccgctgtccgacccgccgcaggcggcgagcagcggcatccctccggcgaccgccgcggcggcgaccgccgtggaagcgaggaagcttctccggctgggggcggaggtggcggagttcggcgtcattgcgtcaacccttcatggcgcaccaggacacccggcggaagagccgtcggctgcggtgtcttgagtggaactgctggctgagcggaagcggtggacatcggagggatgtgagcacgcgaggcgttctccccgagtcgaagcgcttcgatgttgctgcgaggttaagtgaaccgctgggggtgcacaagggtcgattccaagattcctccgaggtgtggaggacgggacccgcctcttctgtcgcctcaaatcaccgccaggaaacggagttgttgcgccgggatgtcttgacacccaccccttcgtcgaatgagcatcgaagcgcttcgaaagcctcccgtcgctccatcgcaaagggatctccacgtgaccgcacaaacgccgcctacgccgtctttccgtgatccgcggctgccgttcgcgaagcgcgtcgacgacctgctggcgcggctcacgctcgatgaacgcatcgcgttcctgcaccagttcacgcccgccgtcgagcgcctcggcatcgccgcgttccgcaccggccaggaagcgctgcacggggtggcctggatgggcccggcgacggtgttcccgcaggccgtgggcctcggcgcgacctggaacgacgacctggtacggcggatcggcgaggcggtctcggccgagacccgtgcgatgcgcgcccgcgacgaccgggtcggcctcaacgtctggtcccccacggtcaatctgctgcgccacccgctgtggggccggggcgaggagggctactcggaggacccgaggctgacctcggcgatcgcgacggcgtacacccgggggctgcgcggcgaccaccccacctactggcgcacggcgcccgtcctcaagcactggctggcccacaacaacgagacgaaccgcgacaccacgtcgtcctcggtccgcccgcgcgtcctgcacgagtacgacctgcgcgccttccgcgagacggtcgaggcgggcgcggtggccggtgtgatgcccgcgtacaacctggtcaacggccgccccaaccacgtctcgccctatctgcgcgagcacctgcgcacctggacggaccaggaactgctggtctgctcggacgcgggtgcgccctccaacctggtcgactccgagcactacttcgacacccacgaggaggcgacggcggcggcggtcctggccggcgtcgacagcttcaccgaccacggcacggacagctccaagatcgtcgagcgggtccgcggcgccctggtccagggcctgttgagcgaggccgacatcgacgaggcggtccgccgccagctcgcgatccgtttccggctcggcgagttcgacccgcgcctcgacccgtacgccggcaccttggacttcgacaccgcggcccatcgcgcgctcgcccgggagtccgcggagcaggcggtcgtcctgctcaagaacgagggactgctgccgctgggccccgaggtgcgcatcgcggccgtgggcctcctcgccgacgagtgcaagctcgactggtacagcggcaccctgctgcaccgctccaccccgctggagggcctgtacgaacgcttcggcgccgaccgcgtcaacttcgcggagggcgtggaccgcgtacgtctgaggacgtcgtcgggcgcctttctgcgggtgcccgtggccgagaacgcggccgaggtcacggccgacgaggcgcgcggcgccgagggcgcgctggacccggcactgctcgcgggccgcaccgacctgcctccgctcacgaccgacgccgtcggcagcgaactcgcgctgatcgactggggcgagggcgtgctgacgctgcgcgcgcccgacggccgttacctctcggtcgccgacgacgggtacgtacgcgcctccgcggaccagccgggcggctgggtcgtccaggagacgttccgcctcgaaccttccgaatcccatgacaacggccacctcctgaagcacacagggacgggcaggtacgtctgtgtcgccgccgacggcgtgaaggttgccgctcaggagccgcgggacgcggagatcttcgaactggagtcgaccgagcgcggcgaggacgcggtgacgcgcgtcgccgccgcggcggacgtggtcctggtgttcgcgggcaacgatccgcacatcaacggccgggagaccgaggaccgtacgacgctgcggctgcccgcccaccaggagcggctgctgcgcgccgcccgcgccgcgaacccggccaccgccctggtcctggtctcggcgtacccgtacgcggtggaccacgccgacctcccggccgccctgtggaccgcgcacggcggccaggccgcgggcaccgcgctggcccgcgtcctgtccggcgacgtctcccccgcgggccggctcccgcagacctggtacgcggacgacgcggacctgcccggcctcctcgactacgacgtgatcggcagccgccagacgtatctgtacttcgagggcacgcccctgttcccgttcggccacggcctgtcgtacgcgtcgttcgcgtacgaggggctcgaacaccgcacggacgaagacacggtgcgggtctccttcaccgtcaccaacacgggctcccgggcggcggacgaggtggcccagctctacatccgggcggtggacccgtccgtcccgcgcccgcgccgcgaactggccgcccaccgccgcctgcgcctcgcccccggcgcctcggcggagctggccttcgcactcccgtcggccgccttcgcgttctgggacgtggcgcacggccgccgacgggtggagccggggtcgtacgaactcctggtcggcgcgtcgagcgaggacatccggctgcgtacgacgatcgagctgaccggcgaggcggcggccccccgcgccgtacgtgcgctcggcctgaaggcggccgacttcgacgaccagcggaacaccgagatcgtcgaccgtacgaaggtgtcgggcgacgcggtgacaccgctggacggcgggacgggcgaactcgtcttccgcgcctgcgacttcggggccggtgtctcgggcgtcagcgcggatctcgcgggcgagggcgtcgtcgagatctccctggccggcggcccgccaccggcggtgctgaccctgcccccgacgaaggggccgtacgactacaccaccgtgacggccgccttcgccgcggacggcgtgcacgacgtccacctcaggctgcgcggcccgctgcggctggcgcaggtcggcttctccggttgagggtccggaacaggccggcacggcagaaaggggtccggcgccggaaggcatcggcgccgggccccgctcacgacacccaccctacatgaaaacgattgtcacaagctggagtgaccccgggcgtcgcacgacaacggccggagcccccgcacagcgggctccggccgttgaagtcggtgcgggcgggtcagagggcgaggcccgtcaggaccagcacccgctcgtaggtgtagtcgtccatcgcgaacttcacgccctcgcggccgacgcctgactgcttgacgccgccgtagggcatctggtcggcgcggtaggacggcacgtcgccgatgacgacaccgccgacctccagggcacggtgggcccggaaggcggcctggaggtcgtgcgtgaacacaccggcctggagcccgtacttcgactcgttgacggcggcgaaggcggccgcctccccctccaccttctgcacggtgaggacgggcccgaagacctcctcgcacgagagcgtcacgtcggccggcacatcgacgagcacggtcggcgcgtacgaggcaccctcgcgcttgccgcccgtcagcacccgggcaccggcctgcgcggcctcgtccacccacgactcgacgcgcttggcggcgtcctcgctgaccagcgggccgacttcggtcgcgtcgtccgacgggtcaccggtgacctgggcctcgacggcggcgacgacccggggcagcagccgctcgtacaccgacgcgtccgcgatcacccgctgcacggagatgcaggactgcccgccctggtagttggagaaggtggcgatacggccggcggcccagtccaggtccgcgtcgctcgcgtagtcggcgagcacgaccgccgcgccgttgccgccgagctccagcgtgcagtgcttgcgcggcaccgagtccatgatcgcgtaaccgaccttctcggacccggtgaaggagatgacgggcagccgctcgtcctggacgagagcgggcatccggtcgttcgacacgggcaggatgctccacgaaccggcgggcaggtcggtctcggcgagcaggtcaccgatgacgagacccgacagcggcgtcgcgggggcgggcttcaggatgatcggcgcgccggccgcgatcgcgggggcgaccttgtgggcacacaggttgagcgggaagttgaacggcgcgatgccgagcacgacacccttcgggaaccgccgggtcagcgccagccggccctggccgcccgcgtcggtgtcgagccgctgagcctcgccaccgttgaaccgccgggcctcctcggccgcgaaccggaacacggagacggcacgcccgacctccccgcgcgcccacttgatcggcttgccgttctcggcggagatcagctgggcgatctcctcggtgcgctcgacgagccgcttgctgacgtggtcgagggcggcggcacgcacatgcgccggggtggcggcgaactcgtcgcgcacggcgtacgcggcggccacggcctcctcggtctgcgcctcggtgggcacggagaccttgccgacgagccgcccgtcccacggagaggtgacgtcgaaggtggtctcaccggtggcctggcggccggcgagccagaaggcgtgggtggctgccacattctcgtttggcatagcgtgaatcccggcccttccgaggttgaggtgtgctgggcttttcgggtccacggtagggccgggacggcgagggatcgtttgtccgagtcgtagcactcccccacccgaacgcgacgctttggcgcggtcgccggactccgccgggctcgcccggggtcacaccccccggcagcgcccgcgccgacgccggttcactctcccgccgcggccgtcgtcttcaacgccagccacagctccatccgcacatccggatcgtccagcgaccgccccagaatctcctcgacccgccgcatccggtaccgcagcgtatgccggtgcacccccagatcggccgcggccgcgtcccactgcccgtgccgcgacagccaggcgcgcagcgacgccacgagatcgccccgccccgtcgcgtcgtgctcgcgcagcgcccgcagcagcccgtccgcgaacgcccgcaccgcgtcgtccgcgagcagcggcagtacggacccggccgccagctcctcgtgctcgacgaggaaacgtccacggcgccgcgccaccgacagcgcctgctcggcctgcttgtacgcggcccccgccgcgatcggtcccgccggcgccgacagccccacgaccagctcgtcctcgtcggtcacgggctgctcccgcgtcgcggcccgcgccgcctccagcgccgccgcgtactccccgcaggcggcgaccgcggcgcccccgtccacggcgagcaccacgagccgctccccgtcgggcacgagcagcacggactcgccggaccgggcggcggcggactcgacgatctccgcgaggccgccgagcgggtccccgttggtctcgggcacggcgacggcggcgggcgagcgcttcgtgggcgccacgcgcgcgtgcctgtcggcatgcgcccgcgcggccgacgcggacgccgactcggccaggatcagccggaacggagcgtcgagcagggcaccgtacagatccccggcgacggcccgggcgtgatcggactccccggccagcagcatgcgcaggacggccgccccgatccgctgttcggcggcgtgcagcgagcgcgaccgctcggtggtcagcgtgagcagggcgatcgcggagtgcacggcgtaccgctcggcggtgccgagggcggcggccgtgccgacggcgagcgcggcgcgcggccggcggccggtgccgagcgagtgcagctcgacgcggtcctcgttgtcgggcgcgccgaccaccgcgctcgcgggcgccggccgctcccgcagccgctccacgtccggggtgatccgggcggcccgtcggcccgcccactcgggtgcggtggcgacgacggcgcccgaggcgtcgtacagcagccgtcccagccgtcgacctgtccggccagcgcggtgagcagcccctcggccccaccgcccagcgcctgcttggtcagctcgcgctgggcggcgaaccctgccgtgaccgcccggtactggtcggcggcgatggccgcggagacggccttgctgatggcgaggaagggcgtgcgccggggcacttcgagcagcggcagcccctctttgtccgccgcgtcgacgagcgcctcggggatctcctcgtagttgaccccgacggcgaaaccgagcccgaccacgcccgcgcccgccaggcgcttcacatagcgccgcatgacctcgggatcctccgcgtccagtttgagcgcggtgatcagcagcagttccccgccctccatgtaggggacggggtcggcgagctcgctgacgtgcgcccagcggacgggcacatccaggcggtcctcgcccgctcgcacggtcagcttgagcgcggagtggtggacgagcgaggcgagcgtggggggcatgaggccttcaggtctgtgtgatctttgtgatcttttggccgctgcgtatgaacgacctgtgtcgattctgcctcaccgtacggtccgaccgtgacgttacatccagacgtccaggtcagccccgtagatccacgagcagcggcggcgcgtgctcgcccgcgacgctggtgagcgacagcaccgcgtggcccggcggcacctcgtgcgccagctcggacgccgaccaccgctcccgctcgacctgccgtacggtcaccgcgtccgtggtcacggccttgccggtgaccagcttgcgcagggcgtggatggcccgcgtcatcggctggtccgcgaagaccgtgtgctgggccacgtcacgggtctccacccactcggtgccccaggcgtgggcgaaccggctgccgtcccacgtcgtgacgccggagaacgccatacggcagccgaccgccccgtacagcggcccgtgcagcgcctcgggcacgtcgccgatcgtgcgcagcgcgaggaccactccggcgttctgggagcgcaggcgctgcatgccgcgtacggattcggtggtcggcgtcccggtggcgtcgtcgaggaccagacagacgaagtgggcccgctccccggcccgctccccgccccgcaccacggcggtgaactgggccagcacgagccgtgcgatcagccgggacgcctcctcgtgcccgcgctcgggcagatcgacgcgcacccgcagcggatgatggaccacggaccgcagtgagaacggccggatcccgctgtccgtaccgccgccgccgaagaacgcggcgaagaccggccggtcgagcagcgcgagccggtcggcgagagccggtccggcgtcggccgcgctcccggcctgccggatgcgggcgtcgagttcccggcgcatcacggcgtgttcgtcccccgccagcgcctcccgcagggacgacagcgccgccggctcgccctccagaagctcccgcagcacgggcagcgccgggaaccgtccgtgcaccgcccggtaggggccgagcagttgggcgagcgcggtggcggcacgccggccgtcgaccgtgtcgaggtctccgaccaggccttcggccaggaaggacgccacctcgtcggggtcgtcggaatccgcgtacgggtccaggtcgtggacggaggagggatcgccgatcttgacgaccacgtcgaacgccgagtccgggccgaggggcgtgccggcggcggcgaccacgacgacggcgcaccgtccggtgagcgctcgcagggtgagcgactcgacgaggggccggaccagctggcgggtcttgccggagccggacggacccaccgcgaggagtgaggtgccgagggtctcggcgtcgagggccgcgccggccccgcggtagacgagcggcgtacggtccccggccgaccagcgcccgatgcgcacctggccttcgagcacgtcgtggcgtgcggtgcgggccggcaggtcccgggcgccggacgggtggacccaggcggcggcgccccggcgcagcacggtgtcgctgaaggcggcgaggcgcgcgccgtcccgcttcgccgcgttccacgcgtgccggacacgggcgcagtccacgtcgttcatccggccggagagcacctctccggagagcaggtccgccgcctggtgctgccccgcgtcatggagttcgggccactgggcgggtggccggggggcggccggggtctcgggcgcccggccgcggccgcgcgcggccaaccgttccctggcgaacggccaccagtcgccgatcctggcgaagggccacaggaccagcagggtgatcagcgcgtacagaccgtcggtgaccagctgcgactggaacacctcgtagccgccggtgagcagggccgtgacggagaagaggggtgcgacgaccggcagtgcgtcccagccgacgccggggaaggcgcgggggaagacgaaggtcagcgtgagcagggcgcccagggcggccagcagggcgcgcgcgggctgcggccggcgggtgacgtagtgacggaccacgtcggaccagcttcccagccgtcccatggcgtagacgaggacggcgaagaacaccccggtgtagacctcgatggcctcctgcccctgccaggtcttcggcgcggtggtgccgccccaccaccagtcgtccggggtgaagagcttcagcacgatccactggtagggcacgctgccgtggcgccacagggaccagacgatcagcgccaccaccagcggcaccgcgagaccgacgatcgtgaccggggagagccgctgcgctcccttcgccggccgtggcacccggtagccgtaccgccagatcccgggtgcggcggccgggcggggttcgtcgagccagtcggcgacggtggccgggcgggccggggcctgctcgggcacggggggcgcgccgcgcggcatgggcggcacgggtggtgggggtgcggcgggtcgtggcacaggagtcgcatgcgtaccccgtgcgtcctgcgtcccgtcgctgtccatcgcccttgccccctgaccagccgctccgtgcaccctcagcgagtcaatctaacgcccccgcagggggagttcaccgtttacgcggccggggcgcccggggatgcgcaccgccgcgccccggggttctatgtccacgacggacaagcacacacgccgaaaacgcccacatggagcatgcccgctccccgtccccggccctagcctgcgaagaaagaaggcaagcgtccgaaaacaccccgccgggaacgtcccggccagccggaaatccccggtggccgcacacccccggttcgcaagatcatcagggagcccctcatgagcgcacttccgcaggagcgccgcgtcgtcaccgccatccccggcccgaagtcgcaggagctgcaggcccgccgtaccgccgtggtcgcggccggtgtgggttcggtgctgccggtcttcaccacgcgcgccggcggcggcatcatcgaggacgtcgacggcaaccgcctgatcgacttcggctccggcatcgcggtgacgtccgtgggcgcctccgccgaggccgtcgtacgccgcgcctccgcccagctccaggacttcacgcacacctgtttcatggtcacgccgtacgagggctacgtcgccgtcgccgaggcgctggccgagctcacgccgggtgaccacgccaagaagtcggccctgttcaactcgggcgccgaggccgtcgagaacgccgtcaagatcgcccgcgcgtacaccaagcgccaggcggtcgtcgtgttcgaccacggctaccacggccgtacgaacctcacgatggcgctgaccgcgaagaacatgccgtacaagaacggcttcggaccgttcgcgcccgaggtctaccgggtgccggtggcgtacggctaccgctggctgaccggcccggagaacgccggtgccgaggcctccgcccaggcgatcgacatgatcaacaagcagatcggcgccgacaacgtcgccgcgatcatcatcgagccggtgctcggcgagggcggcttcatcgagcccgcgaagggcttcctccccgccatcagcaagttcgccaaggacaacggcatcgtcttcgtcgccgacgagatccagtccggcttctgccgcaccggccagtggttcgcgtgcgaggacgagggcatcgtcccggacctgatcacgaccgccaagggcatcgcgggcggtctgccgctcgccgccgtcaccggccgcgccgagatcatggacgccgcgcacgcgggcggcctgggcggcacctacggcggcaacccggtcgcctgcgcgggtgcgctcggcgcgatcgagacgatgaaggagctcgacctcaacgccaaggcgaagaacatcgaggccgtcatgaaggcccgcctgggtgccatggccgagaagttcgacatcatcggcgacgtccgcggccgtggcgggatgatcgcgatcgagctggtcaaggaccgcgacaccaaggagccgaacccggaggcggccggcgcgctcgccaaggcgtgccaccaggagggcctgctggtcctgacctgtggcacctacggcaacgtgctgcgcttcctgcctccgctggtcatcggcgaggacctgctgaacgagggcctcgacatcattgagcaggcgttctcccgtatctgacgccccacacgtcccgtatccggggtccgggccggattccggtgcgggacggcagggggcggagcgcgtgaagaacgtgtgcaaggtggatggcgggacgcgattccggctgtcgcagcggatttccctgccgtaggttctacccagatgagagatacaccccgcccacaggggactgtggacggcttcgggccgaggcctccccagcttcgacctggtcgtgccctcgcgcacacacccggagcttccggctccggttctcctcaccgatcggatggccgcacgccccaaaccccccggggcgggcggcacaccgatctggacggccgccccggaaccaccccccctgttccggggcggccgaccttcctcctcggcctttcggcccttctcctcgcgctgatcacctggcaggtcgcggcccacggccccctggcccgcgcggacgaacgcctcagcggcacgctggtccgtccgggccgcttctccgaactcctcgccgatctgggcaacgccacggtcgcggtaccggtgctggccgtcgtcctggtgtacgtggccgtacgcgaccgccgggccggtgcggatcgctggtggctcccgtccacggccgcggcgctcctggtggcggccctcccggccctgatcgtcccgctcaaggaactgatcgcccgcccgggacccccggtcatgggcccgggcacgggcttctatccctcgggccacaccgccacggccacgatcgcctacggcacggcggccctgctcctgctgccccggctgcacgccacctgggcccgccgcaccgtgctcgccgcctccgtcaccctgaacctcgcggtcgccgtcggcctgatccgccgtggctatcactggccgctggacgtcgtggcgagctggtgcctgggcgcgctgctgctgacggcgctcgcgatgttcctcagccgaagtactggtcgaagttccgctggaactcccagctcccgaaccggtcccagttgatcgaccacgtcatcaggccgcggagcgcgggccacgtgccgtgggtcgcgtacgagccgcagtcggtcttcctcgtgaggcagttcagggtcttgttcacctccgtgggggacacatggccgttgcccgcgttcgtcgaggccggcatgccgatcgtgatctggtcggggcgcagcggcgggaagacgttgttggcgtcgcccgccaccgggaagcccgtcagcagcatgtcggtcatggcgatgtggaagtcggcgccgcccatcgagtggtactggtcgtcgagccccatgaccggacccgagttgtagtcctggacgtgcagcagggtgaggtcgtcgcgcagggcgtggatcaccgggaggtacgcgcccgccctcgggtcctggccgccccacttgcccgtgccgtagtactggtggccgagctggacgaagaaggtctccggcgccatggtcaggacgaacgtcgagccgtacctcgccttcagggtcctcagcgccgagatcaggttgacgatcacgggtgtggtcgggctcttgaagttcgtgtcgctcgcgtccagcgccagcgagtgcccctcgaagtcgatgtccaggccgtccaggccgtactcgtcgatgatcttcgagacggaggagacgaaggtgtcgcgcgccgccgtcgtggccagctggacctggccgttctggccgccgatcgatatcaggaccttcttgccggccgcccgcttcgccttgatcgccgccttgaagtcggcgtcgttctcgacgttcgggcactcggtgaccgggcagcgcgtgaagcggatgtcgcccgaggtggtggaggtcggttcgccgaaggccaggtcgatgacgtcccagctgtcgggcacgtccgccatgcgcgtgtagccggagccgttggcgaagctcgcgtggaggtagccgaccagggcgtgggcgggcaggtccgtcgagccgccgcccgagcccgccgacgtcgtggccggcaccgtcgccgacttcgccgactcgcccgcgtcgttcacggccgcgacctggaagccgtacgccgtggccggtgacagaccggtcaccgtggccgaagtgccggtcacggaccgggccttcaccccgtcgcggtagatcgcgtaccccgtggctccggggaccgccgaccaggacagggcgacactcgtggacgtcaccgtgcccgccttcaggcccgtcggcgccgccggtggctgacccgcgtccacgcccggaccgaccagggagatgtcgtcggcgtagtaggcgccggtgccgtaccagccgtgggtgtagaccgtgacctcggtggtggacgggccggtgcggaacgtggtggtgagctgctgccagtcgggggcggactgggtccaggtggagacgtcggtggtgccggtgccgctcgcgccgaggtagacgtagctgccccggacgtatccggacagggtgtactgcgcgtccggtttcacggtcaccgtctgcgcgcactgggcgtgatcgctgccggccggggtcgcctggagcgcggaacctccgctccgtacgggcgagttgacggtctttccgctgtcggccgcacatgtccaggcgttcaggccggactcgaacccgccgttgcgtgcgaggtccgcgtcggccgcgcgggcggccgacgagagcgcggtcattgcgggtacggccaggacggcggccgcgcccacggcgagaagtctgtgccgccgtgggcgcggcacggtgcgtcgggtgcggtccacaagtgcctccgggcaggggggaagaggagggtggagcgcgcccaacttggtccagaccaattcggttgtcaagacctccggcggttacctgccgtcagggaccggtgcgaaccggggcacagcggtggcgcggggcgtacgccgttcgagcggaacgcgacccgcccgcgcgccaccgcgagcgtcagctgtcgaagcccagacccagcctgtccatggccttcagccagaggttccgccggccgccgtgcgcgtccgcgcgtgccagcgaccacttggtgagcgcgatgcccgtccaggcgaacggctccggcgggaagggcagcggcttcctgcggaccatctccagctcggtgcgctccgtgcgctcccccgccagcaggtccagcatcacgtccgcgccgaaccgggtcgccccgacgccgaggcccgtgtagcccgccgcgtacgcgacctttccctggtgcgcggtgccgaagaacgccgagaagcgcgagcaggtgtcgatcgcgccgccccacgcgtgcgtgaagcggacgccctccagctgcgggaagcaggtgaagaagtgcccggcgagcttggcgtacgtctcggggcggtcgtcgtactcggcccgtacccggccgccgtaggggtagatcgcgtcgtaaccgccccacaggatccggttgtcggcggagagccggaagtagtggaactggttggcgctgtccccgagtcccctggcggttcttccagccgacggcggccagctggtcgtccgtcagcggttcggtcatcagcgcgtagtcgtagaccggcacggtgtacgcgcgcacccgcttgatcagattcgggaagatgttggtgccgagcgcgacccggcgggcgcggatcgagccgtagggggtgcgtacggccatgccggcgccgtacgcctcgaggttcagggcgggtgtgtgctcgtacacgcgcacaccgagtccgagacaggcgcgcttgaggccccaggcgagcttggccgggtggagcatcgcgacgcccccgcggtcgtgcagcccggccaggaaggtcggcgagtcgacctgttcccgcaccgccccggcgtccaggagatcgatgccgtccgcgaggcccttccgccgcagcttctcgtaccacgcgcggagttcctcggcctggtgcggctcggtggcgacgtcgatctcgccggtgcgctcgaagtcgcagtcgagggagtagcgggcgacggccgcctcgatctcgtcgaggttgcgggcgcccagctcctccagcttcccgatctcgtccggccagcgggcgaggccgttggccagaccgtgggtgagggaggcggcgcagaagccgccgttgcggccggaggcggcccagcccacctcgcggccttccagcaggaccacgtcgcggcccgggtcacgctccttggcgagcagcgcggtccacagtccgctgtagccgccgccgacgacgagcaggtcgcaggtctcggcgccggtgagggcgggctcggggcggggcctgccggggtcgtccagccagtacggaaccggctgcgcttcggaaagagatgtggtccaacgactcatggcgcttggggccatgatttcaactccctacaggtgaatcgctttacgccttctgccggttacggcgattgccgacgaccattccggccagaacgaacagcacggcgacaaggaacatggccgtaccgatgacattgatctgaacgggtgtgccgcgctgtgccgatccccagacgaacatggggaaggtgacggtcgagcccgcgttgaaattggtgatgatgaaatcgtcgaaggagagcgcgaaggcgagcagcgcgcccgcggcgattccgggggccgcgatgggcagggtgaccctgaggaaggtctgcaccgggccggcgtacaggtcctgtgccgcctgctccaggcgcgggtccatcgacatgacgcgcgccttgacggctgtcacgacgaagctgaggcagaacatgatgtgggcgatcaggatcgtccagaaccccagctgagcgcccatgttgaggaagagcgtcagcagcgaggcggccatgacgacctcgggcatcgccatcggcaggaagatcagcgagttcacggcgccgcgcgcgcggaagcggtagcggaccagggcgaaggcgatcatcgtgccgagggcggtggccccgacggtcgcccagaacgcgatctggaggctgagcgagagtgagccgcacatgtcggcgacaccacagggatcgcgccaggcttccgtggagaactgctgccattcgtagttgaagcgccccttcggtttgttgaaggagaacaccgtgacgacgacgttcggcagcagcagatagccgagcgtgaacagtcccgcgatgacgacgagatgatgcttgagccagcgcacgaagggcatttagaccagatcctccgtcccggacttgcggatgtagagcgtgaccatgatgaggatcgcggccatgaggatgaacgagagtgccgcggccgtcggatagtcgagaatccgcaggaactgcgtctggatgacgttgccgaccatgcgggtgtccgtggagccgaggagatcggcgttcacgtagtcgccgctggccgggatgaaggtcagcagcgttccggagacgacgcccggcatcgacagcgggaaggtgaccttccggaaggtggtgaacggcttcgcgtacagatcgcccgccgcctcgtggaggcgtccgtcgatgcgctccagcgaggtgtagagcgggaggatcatgaacggcaggaagttgtacgtcagaccgcagaccaccgcgagcggggtggccaggacgcggtcgcccgcggtcatgccgagccagttggtgacgtccaggacgtgcagcgagttgagggtgccgacgaccgggccgccgtccgcgaggatcgtcttccaggcgagcgtacggatcaggaagctggtgaagaacggcgcgatgaccaggatcagcacgacgttgcgccagcggccggcgcggaaggcgatcagatacgcgagcgggtagccgagcagcagacacaggagcgtggcggcgcccgcgtagagcacggaccgcaggaactgcggccagtagtcggacagggcgttccagtaggtctggaagtgccaggtgaccttgaagccctcctccagggaacccgtctgcacggaggtggaggcctggtagatcatcggcagcgcgaagaagaccaccagccacaggaggccgggcagcagcagccagtacgggacgaggcggccgcgtttgcgcgccttgggcgacctgggcggcttctcggcggcgggcggggcgagcggcggcggggcgtcggcgaggctcgtcatcacgcggcctcttcctcgaccgtctccacgcccgcgtcgatgtcctgcgcggcgtccagaccgaaggtgtgagccgggttccagtgcaggacgacgtcggcgccgggggtgagccgggagtcgcggtcgatgttctgggcgtagacctcgaactcggggcagaccgcgctgtcgatgacgtactgggtggagactccgatgaagctggagtcggcgatcttcccggtgatccggttgcggcccgccgggatctcgcccgcgtcgtcggcgtgcgtgagggagatcttctcggggcggacgcccacaaggaccttgccgccggtcgtcgtggccgccgaacatcgcgccgtgggcagcgtgagcttgccaccgcccgccctgaggacgatctcgtcgccgcccttggagtcgacctccgcctcgatgaggttggaggtgccgaggaagttggcgacgaacgtggtgttcgggttctcgtagaggtcggcgggcgagccgagctgttcgacgcggcccgcgttcatcacggcgaccgtgtcggccatggtcatggcctcctcctggtcgtgggtgacgtgcacgaaggtgatgccgacctcggtctggatgcgcttgagctccagctgcatctgacggcgcagtttgaggtcgagggcgccgaggggctcgtcgaggagcagcaccttggggtggttgatcagcgcgcgggcgacggcgacgcgctgctgctggccgccggagagctggtgcggtttcttgcgcgcctgctcgccgagctggacgaggtccagcatgtcctcgacctgcttcttcaccgacttgatgccgcgccggcgcaggccgaaggccacgttctcgaagatgtcgaggtgcgggaagagggcgtacgactggaagaccgtgttcaccggtcgcttgtagggcggcaggtgggtgacctcctggtcgccgaggaacacggtgccggaggaaggttcctccagtcccgcgatcatgcgcagcgtggtggtcttgccgcagccggaagcgccgagcagggcgaagaacgagccctgcggcacggtcaggtcgagcggttgcacggcggtgaaggagccgtaggtcttgctgattccggagaggcggacgtcgccgctgttgtccgtgttgttcatcgtcgtcacgcccctgtgagcttcgcgaacttctgctgataggccgtctcttccttcgagctcagtgagcggaaggcatgggacttggcctgcatggccttgtcgggaacgatcagcgggttgtccgccgccgacttgtcgatcttggcaagatagggctgcactcccgcgaccgggctcacgtagttgatgtaggcggcgagttcggcggccggctccagctcgtagtagtagtcgatgagccgctccgcgttcgtcttgtgacgcgccttgttggggatcagcatgttgtcggtcgacgtcatgtatccgctgtcggggatcacgtagccgacgtcggggttgtccgcctggagctggacgatgtcgcccgcccaggcgatgcaggcggcgaagtcgcccttgctgaggtcggacgtgtagtcgttgccggtgaagcggcggatctgccccttgtcgacggccttctggagacgggcgatcaccgcgtcgtagtcgtcgtccgtgaacttcgccgggtccttgcccatgtcgagcatggtcatgccgacgctgtcgcgcatctcggtcaggaagccgacgcggcccttgagcttggggttgtcgagcaggtcggagaccgacttcacctcgacaccgtcgagcgccttcttgttgtacgcgatgacggtcgagatgccctgccacgggtacgagtaggcgcgtccgggatcccagtcgggggcgcggaactggtccgacaggttggcgaaggcgtgcggcaggtgggacgggtccagtttctggacgtagccgagccggatcatgcgggcggccagccagtcggtgagcacgatgaggtcccggccggtggactgacccgcggcgagctgcggctggatcttgccgaagaactcgtcgttgtcgttgatgtcctcggtgtacttgacctggatcccggtccgcttggcgaaggcgtcgagcgtggggtgccgcttgccgctgtcgtccacgtcgatgtattcgggccagttggagaagttgatcgtcttctcctcggccgaatgatcctcggcggagacgccgccctcggtcctgcccgccgcggggatcccgcaggcgctcagcgccccgagaccgccgaccgcgagcgcgccgccggcggaggcgcgcagcagcgaacggcgggtgagggaggccctgccgttcctgaaactgcgccgcaccgcggccagttgggccggggacaggcggtcgggctcgtactgctccatgtgcgtgatgcctttccggtggagtggttcggccttggtcgacggccggtggtgccacccggcggtagccggaaaacgattacggccggtccccgaagatcgtgcggtgccagtcctttcggacaattgctgtgttatcgaacataacgtgcttgatctgggtgtactcctcgaacgagtacgcggacatgtccttgccgaagccggacgccttgtatccgccgtgcggcatctcgctgatgatcggaatgtggtcgttgacccacacgcagcccgccttgatctcgcgggtggcgcggttcgcgcggtacacgtcccggctccaggcggaggccgcaagcccgtacggagtgtcgttggcgagccggatgccctcgtcgtcgctgtcgaaggggaggaccaccaggacgggcccgaagatctcggactgcacgatctcgctgtcctgggcggcgtcggcgatgagcgtggggcggtagtaggcgccgtccttgagctcctcggggatctcaccgcccgtcaccacgcgcgcgtaggcacgggcccggtcgacgaatccggcgacgcggtcacgctgggcgtgcgagacgagcgggccgaggtcggtgccgtgcgcgaacgggtcgccgagacggacggtctccatcagggcggcggtgcgcgcgacgaactcctcgtagaggggcctttgcacatacgcgcgcgtggcggccgtgcagtcctggccggtgttgatcagcgagcccgcgaccgcgccgtgcacggcggcgtccaggtcggcgtcgtcgaacaccacgaagggcgccttgccgcccagctccaggtggagccgcttgacggtggaggtggcgatctcggcgacgcgcctgccgacggcggtggagccggtgaaggaggtcatggcgacgtcggggtgcgcgacgaggtgttccccggcgtccctgcccgcgcccgtgacgatgttgacgacgccgtcggggatgcccgcccgggtggccgcctcggcgaagagcagggaggtgagcggggtgatctcggcaggcttgaggacgatcgtgttgcccgccgcgatcgccgggaggaccttccaggcggccatctggagcgggtagttccagggcgcgatggaaccgaccacgccgatcggctcacggcgtatgtacgaggtgtggtcgccggagtactcgcctgcggactggccctgcagatgccgggcggcccccgcgaagaaggaggtgttgtcgatggtgcccgggacgtcgaactcgcgcgtcagcttgaggggctttccgcactggagggactcggcgcgggcgaactcctcggcgcggtcggcgaggaccgcggcgaagcggtgcagggcgtcggagcgatcgccgggcgtggtggcggcccagccggggaacgcggcgcgggcggcggcgacggccgcgtccacgtcggcggtgcccgccagctcgtaccggtagacctcctcgccggtggcggggtccacgaccgcgtgacggcgccccgaggttcccttggcgaacctgcccgcgatgtactgcgcgccgtccgcgaagcggtcctgcgcctggaagcgatggcccggattgtgcatgtcgctctcctccgccgttcaccccgcagggcgggggtcggcgtagctccagcttgatttgactgccgatcctgacagagcaataggactccaacaagtgattccgttgttgccttttggttacgcgacggaatctgtcgaccaggtgtcgagtcctcacggaaaaggcaggacggagtgtcagtggtgcgtgccagactcgcgtgcatggggaagatcgattcttgggaagccctggtcagggaggtccacgcgggggcgaggatcaagtacctgcacttctggggacaccggccgcgaccggacggacgggtgggggcgagctgcctgagccagtggtggccgtctccgttcaccgtggacggcgtggagtacacgacggcggagcactggatgatggcggcgaaggctcggctcttcggggacgaggaggctcagcggcgcgcgatcgaggcgcccactcccgcgcacgccaagaaggcggggcggctggtgcgcggcttcgacgaggccatatgggcgcgcgagcggtacgggatcgtggtcgagggcagcatccacaagttcgccgcgcacatggatctgcaggcgttcctgctgggcacgtccgggcgggtgctggtcgaggcgagccccctggaccgcgtgtggggcatcggcctcgcggcggacgacgagcgggcaggcgacccggatcggtggcggggcccgaatctgctggggttcgcgctgatggaggcacgggaacgactggcggccggcgaccgctagggcgtgtccggtggctcgggacctagcggtccgcgtgcacgaccagggacgtggagtagctgtcgtcggtggtgctccacgggtcgctgctgctctccgcggcggcgaagatgatcaccatgaaggcgacaccgagcacgatgccgaccgctccgcagatgatcccggcgagggcttggccggcattcgtcgcctctccccggcgcgctctgcggcggccgatcacaccgaagacgacgctgagcacgcccatgacgatggcgagcggccagagacagaacacgacggtcgagatgatgccgagcaccagcgcggcggtgcccatgccgttgctcggcgggaggggcatccccggccagccgtagccgggtgcgcccgcgtggggtccgtacggggatccgtgggcggggcccgcggggtagccgggggcggggtgaccggatcccgggtagccgggcccggggtactgggggtagccgggagcggggtactgggggtagccgtacgggacctgtccgggcccgtcgggaccgatgggcggcggggggacgggctcaccaggggccggctgggcgaaggaggcgggggaagcagggggtgcgaaggggttgtccgaaccgctgacgggggcggcgaacgggttggcggcggacgacggcggcgtgtgggcctgcggtggcgtcggcggggcgaaggggttgcccgacgaggccggtgaggcggcaggcgaggcctgagcggcgccgggtgcggcgaagggggcgtcggtgcgtcggcggccggcggggcgaaggggttctgccagagcggcgcgcccgacgcacccgcgtcgggcggcgtgcccgcgcccggcacggagacgacggtggcctggtcgtgcacggagggtgtaccgacacccgggaccgccgtgtcctgaggtgcgggggcggtgtcctgggacgcggcggcggcgctgtcaccggacgacgccgcgtcccggggcgcggaagggatgccgtcgccgtaaacgagagtgtcctggggcgatccagcggcgatgtcggcgtggagcccggtgtcgtcgtgcggtacggcggggacgctgtcgcccgagagcaccgtgtcctcgggtgatatgccgccgccgggctgcggtgccgtgtccgccgggggtgcccacgggttcggctcgggtcgggcgtcctcgacacccttgcccggatccacccgcggcacgggtaccgcgtccgcctgctgcgcaccctgcgccctcgcgtcggccggggtgcccggctccgggggtgcccacgggtccggcgcggcgttctccggtgccttgggcgcctgagcgtcgtcggacatgcgcggggtcccctctgtcgtgcgttccgtcatgctacggcccgagcctccctcgcgggggccgcagcctacgatgatccctgagtcaccgatcagccgatcacccgcgtcccgcccgcagccggtgcgaggacgccgttcctggggaggaacccttgaccgagcacttcgacgcccgtggcacccgcgacgcccagaccgggcgcgacctgcactccttcatcgccggactgccgaaggccgaactgcacgtgcatcacgtcggctccgcctccccccgcatcgtctcggagctggccgcccgccaccccgactccagcgtgccgaccgaccccgaggccctggccgactacttcacgttcacggacttcgcccacttcatcaaggtgtacctgtccgtcgtcgacctcatccgaacccccgaggacgtccggctgctgacgtacgaggtcgcccgtgaactcgcccggcagcaggtgcggtacgccgagctgaccatcaccccgttctcctccacccggcgcggcatcgacgagcgcgcgttcatggacgccatcgaggacgcccgcaagtcggccgaggccgagttcgggaccgtactgcgctggtgcttcgacatccccggcgaggcgggcctggagtccgccgaggagacggtgcggctcgccaccgacgaccggctgcgccccgaggggctcgtctccttcgggctcggcggccccgagatcggcgtaccgcgcccgcagttcaagccgtacttcgaccgggcgatcgccgccgggctgcggtccgtgccgcacgccggtgagacgaccggacccgagacggtctgggacgccctcaccgacctgcgcgccgaacgcatcggacatggcaccagctccgcccaggacccgaagctgctcgcccacctcgccgagcaccgcatcccgctggaggtctgcccgacctccaacatcgcgacccgcgcggtccgcacgctcgacgagcaccccgtcaaggagttcgtccgggccggcgtcgtcgtcaccatcaactccgacgacccgccgatgttcggcaccgacctcaacaacgagtacgcgatcgccgcccgcctcctcgacctcgacgagcggggcctcgccggcctcgccaagaacagcgtcgaggcgtccttcctcgacgccgcgggcaaggcccggatcgccgccgagatcgacacgtacaccgcggcatggctcgcgccctgaaccaccagcacgccacgatcacgagggatcccatgcgcaccgtgacagccgtcgcccaccgtggcgacccctatcgcgtccgcgagaacacgatcgactcgctgcgttccgcgctccggcagggcgcggacgcggtcgagatcgacgtacggctcacccgtgacggcgttcccgtgctgctgcacgacgagacgctgaagcggctgtgggagcaggaccggccgctgcggtcgctctcctgggacgaggtccgggggctgacggacggcggggtgccgacgctggtcgacgcgctggcggccaccggggagagccgggtcatgctggacctgccgggtgccggcccccgggcggtgcgcaggatcgtcgacgtcatccgggagtacggagccgaggagcgcgtgtactactgcgccggggccccggccatgctcgcggtgcgcgcggccgaccccgccgccgagatcgccctgacctggacgacgctcgcaccgccgcgccccgcgctgctcgacgcggtgcgcccgcgctggctcaactaccgcttctcgctggtcgaccgcgagctcacggcacgcgtgcaccgcgagggctatctgctgtcggcgtggacccccgacacccgccgttcgatgcggcgtctgctcgacatgggcgtcgacgcgatcacgacgaaccgtatcgacgcgttgtgcgcgttgcgcaaggactgagtctcacgaggcccgagccacgggggccgattcatggggggccgattcatggggggccgttcatggggggccgttcatgaggggggacttagtcacggggggaccgagtcaatgggggttcagggagtgacgcgggagcgctgccgtaccgtcgccgggtccgcgggggcggaccgcgtcaggtactgcggcaccggggccgtgtccttgccgttgtcgcgtacgaggccgtagcggacggcgccctgttcgggccccgtgcggacgtcctgggccgccttgccccaggacgaggtctcgacgaagaggttgtagtcggcgccgcgctcgttctggtggagggtgacggtgccgtcgatccagaagtactcgttctgccacatctgctgggtgccggacggcagtacggccaggccggtggccggaccgcccatccaggtcgtgccgtccgtggtgccgggctgcggatcgtccatacggtggccgccgcccgaggcgacgtggaagagcctgccgtcgagtccggtccaggccggcatcgcgacgctccccggacgttccttgggctggatctgccaccggacccggaaatagccctctccgctgagggtgaccgtctcgccgcgatgggtcagaccggtcgcgggtgcgcccgtcgcggtgacgcccttctcggcacggcggggcagcaccttgggcggcgtatccgccgagggcgcgctgtcgacggcgtcgacgacagtgccgtacagcgggacccgggtcttcgacgggctcgggctggggctcgtggtgcggctggggctcggcgaggcggaccgggtgaccgacggcgggcgcgccgtgctcgccgccgtcggcgcggcgacagcccggcgcggcgggtggtcgggcgtctgcgtcacgacgtacacgccgcccgccgcgaaggtcgcgcccgccgtgaccgcgacggcgggcttgccgagcacaccgagcaccttggcggaccagccggccgacgccgccgtggcggccgccgccggtttgccgccgagcgccagcgacagggtgaaaccggccgggaccggaacgagcgcgatcccggcgaggagccgctctgccggtacgaccgcctcgcccggcccggcgcagtacccgcagccccggatgtgccgggccagcctcttgcgccacaccgagtcgggccgtccgctccagcgggcggtcatgtcacgcagctcggggcaggacgagtcgagggcacgcacgatgccgcgcgcggtctccaggcgggccttcgtccgctgcacccgtacggcggcatgctgacggctgatgccgaccgccgccgccagctcacgccgggtcagttcgcccgcgacctccagccaccacagggacagcagctgccggtcctcggcgtcgagccagcgcaccgcctccgcgacctcacgccgctggccctccaactggagccgcagaacggtgagttcggcgaagtccacggcctggtcgcccgcgccgtcggtcaggggctccgccgtgcgccgccgggcccggtcacgtatctgccgcatcgcgatcgcgaccagccacgaccggaagctgtccggatcgcgcagcgagccgaggtggtcgacggcgcgcagcatggtctcctgcacgacgtcgtcgacgtccgcgtggccgcccagggcgcggccgacgacgttgtagaccagcggcagccagcccgcgaccagctcgtcgagtgcctcccggtcaccggcctgcgcggccgcgatggtggagtgccactgccgcccgtccacgtacgtccctttcgatggcgcgctgatcagagcaggatgccccgaaccaggttggacctgcccgtgcgctatgccgcaggtcacagtcggctcgtggagccctcggacaccacgcgtggagtcctcggacaccacaggagacggagtgccgccctccgcaataacagtttttcctcccgccgaagaactttcgctccatccgccccggggactccggcaacacgtcggcacgccaagggggttgaccggggtcggcgaggcggccggcggcgctcaggcggtgacgaccgcggccgcgggcggggcggccgtgagcgcctccagccgcttgatcttcttgcgcaggacgtacagcgggatcaccccgaagaccccgaacgacatgtcgacgaccgaccaccagaagggaatgccgcggatcggaccgcagatgagggcgagcgggacgatgccggcgcagccgatcatgccgaactcgacgacccagatgttgcggacggggtcgcgataggggccgtagaaggcgaccgcgatcacgaggtgcgcgaacgccagccagtccgtgccgtacagcacgaaggggtacttcgcgtcggtggcgtcgagcccgcggcggacacgctcgatccagtccatcaggccgggcaggcggtccggcacggaaagggaccgcagcaggtcctcggtccagcgcagttcgtgcaccagggggaaggccgtggcgccgctgagcaccaggcagacgacgaagacgaccagccacccgcggatgcccttgagaagggcgactctgtcgctcatgactggagcgtaccccccgacttgaacgcgttcaaaaagcattccgggccacttcaccccgaggacgccgtctgacgtaaggatgcgttgacgtcaaggtggcttgatggcaccgtggaagacgtggccactcctgacgagctagagcgccagtacacgctgctgtccgccgcggcgcgtttcgacgcactgcgcacacgcgacgccctcgccccgcccccggacgacgtggacgacgtggacgacctgggtgacgggggcggcggggacggcgccgagccggacgaggccaccggatcggcggcacccctgacccgcgaggaagcccttgagcttctcgcgctcggcgaggtgctcgcccgcaaggcggcctacggccgtcagctctccgtacggtccgcccgccgggccggtgcctcctggtcacagatcggcgccgccctcggcaccagcaagcaggccgcgtgggaggcgcacaatcgctggatcgacgaacaggccaaacaggaccgggaagccggacactggggactgaacgacaaggagatcgacgcggcccggacgctcgcgggcgagctggacaactagggcatacgtcatgcgccgcaccccggtcccgcctccgccccgaccgcccgtcgtggccctacgaccaccgcacccttcctgaggagcgatcaacgatgttcgagaggttcaccgaccgcgcgcggcgcgttgtcgtcctggctcaggaagaagcccggatgctcaaccacaactacatcggcaccgagcacatcctcctgggcctgatccacgagggtgagggtgtcgccgccaaggccctggagagcctcgggatttcgctcgaggcggtccgccagcaggtggaggagatcatcggccagggccagcaggccccgtccgggcacatccccttcactccccgtgccaagaaggtcctggagctgtcgctccgcgaggcccttcagctgggccacaactacatcggcacggagcacatcctgctcggcctgatccgtgagggcgagggtgtcgccgcccaggtcctggtcaagctgggcgcagacctcaaccgggtgcggcagcaggtcatccagctgctctccggttaccaccagggcaaggagagcaccgtcgagggcggtcctgccgagggcaccccctccacgtccctggtcctcgaccagttcggccggaatctcacccaggccgctcgtgagtccaagctcgacccggtcatcgggcgcgagaaggagatcgagcgggtcatgcaggtgctgtcccgccgtacgaagaacaacccggtcctgatcggtgagcccggtgtcggcaagaccgccgtcgtcgagggcctcgctcaggcgatcgtcaagggcgaggtgcccgagaccctcaaggacaagcacctctacaccctggacctgggtgcgctggtcgccggttcccgctaccgcggtgacttcgaggagcgcctgaagaaggtgctgaaggagatccgcacccgcggcgacatcatcctgttcatcgacgagctgcacacgctcgtcggtgcgggtgccgccgagggcgccatcgacgcggcttcgatcctgaagccgatgctggcccgcggtgagctgcagaccatcggcgccaccacactcgacgagtacaagaagtatctggagaaggacgcggctctcgagcggcgtttccagccgatccaggtggcggagccttccctcccccacacgatcgagatcctcaagggcctgcgggaccgttacgaggcacaccaccgtgtctccatcacggacgaggccctggtgcaggcggcgacgctcgccgaccgctacgtctcggaccgcttcctcccggacaaggcgatcgacctgatcgacgaggcgggttcccggatgcggatccgccggatgaccgcgccgccggacctgcgcgagttcgacgagaagatcgcgggcgtgcgccacgacaaggagtccgcgatcgactcgcaggacttcgagaaagccgcctcccttcgcgacaaggagaagcagctcctggccgcgaaggccaagcgggagaaggagtggaagaccggcgacatggacgtcgtcgccgaggtcgacggcgagctgatcgccgaagttctggccgcgtcgacgggcattcccgtcttcaagctcacagaagaggagtcgagtcgtctcctgcgcatggaggacgagctccacaagcgggtcatcggccagaaggacgccgtcaaggcgctgtcgaaggcgatccgtcgtacgcgtgcgggtctgaaggacccgaagcgtccgggtggttcgttcatcttcgcgggcccgtccggtgtcggtaagaccgagctgtcgagggccctggcggagttcctgttcggtgacgaggacgcgctgatctccctcgacatgtcggagttcagcgagaagcacacggtctcgcgtctgttcggttcgcctcccggttacgtgggctacgaagagggcgggcagctgaccgagaaggtccgccgcaagccgttctccgtggtcctgttcgacgaggtcgagaaggcccacgcggacatcttcaactcgctgctgcagatcctggaggacggtcggctgaccgactcccagggccgggtcgtggacttcaagaacacggtcatcatcatgacgaccaacctcggcacccgggacatctccaagggcttcaacctgggcttcgccgcccagggcgactccaagtccacctacgagcgcatgaagaacaaggtcgcggacgagctcaaacggcacttccgccccgagttcctcaaccgcgtcgacgacgtggtcgtcttcccgcaactgacgcgggacgacatcctcgcgatcgtcgacctgatgatcaccaaggtcgacgagcgcctcaaggaccgggacatgggcatcgaactcgcccagtccgcgaaggaactgctcgcgcagaagggctacgaccccatgctcggggcgcggccgctgcgccgcacgatccagcgcgagatcgaggacaccctctccgagaagatcctcttcggggagctgcgtccgggccacatcgtggtcgtcgacacggagggcgagggcgagaccaagaccttcaccttccgcggcgaggagaagtcggccctgcccgacgtccccccgatcgaacaggcaacaggaggtgaccggccgggctcgggtacggagtcctgacaccgggccttgcgtccggcccctcccgcgccgcgccgcgctgggcggcgcggcgcggggggcggggggctggcgcgggaggggccgggccggtcagcagctcgaagtcatcagcctcggcatcgattcgtcatccatcgattcaaggtatgcatcgcttcaagacatgcatcgcttcaagcgttgcttcaaggtatgcatcgcttcagggtatatcgattcgatgtgggatgatggcggccatgctcgaactcgcgatcctcggcttcctcgcaggcggcccgctgcacggctacgaactgcgccgccgtatcgcgcagctgtccggccacaccacccctgtcagcgacggcagcctctacccggcgatcaaccgtctggtgaagcgggggctgctggaccgacgtgtcgagccgggcgcggcggccgcccagcggtacgtgctgagcctgaccgaggccggccacgccgaactgcttcagcgcctgcggcacccggccgaccaggcgatcaccgacggcagccagttcttcacggtcctggccttcctctcccggctgccggacatcgccgaccagcacgcggtgctgcgccggcgtctggcgttcctggaggagccggcgagcttcttctacgacggcgaccgcccggtgcgcgcggaggaggtcgccgacccctaccggcgcggcatgatgcgggtcgcccgcgccaccagccgtgccgaacgcgcctggctgcacgaggttctcgacacccctgaccaggcaggacctggtgacgcgcgcacggcgaacggcgcggctacgcccgacgagcacgtcgactgagacgctacggagggtgcacatgcctgcgtcggcgatcccgtgcctcgcgccgttcgccgtgcggcccgtggcccgcccacccgtccgcccacccgtccgcccgtccgtccgtccatccgtccgtccgtccgtccgtccgtccgtccgcagcgcactccgcgcacaaggctccacctcgaccggaccgacatccacggcggtctgcgcagcccgacactaatgtcggcggcatgaccgaacacaccctgcgctctgtcagcgtcgagcggaccagcaccggccacttcaccgcgacgaacgtgcgcggcggcacgatcggcttcggcaccggctccgatcccggcgacaccgacttcaccccggtcgagctgttgctcgccgcgatcgggggctgcaccgcggtagacgtcgacgtcgccaccagccgccacgcggagcccaccggattcgccgtcaccgtcaccggcaacaagatcagtgacgagctcggcaaccggatgaccgacctcgtggtcaccttctccgtcgccttcccggacggtgaacccggcgaccgcgcccgcgcgatcctcccccgggcggtcaagtcctcccacgaccggctctgcacggtcagccgcacggtcgagatcggcacgcccgtcaccgcgcgggccgcggacacctgaccccaccgaaaccgccctggccgttcgcgccccgcgccctcgaccgactcactcggagccggccaaaaggatgccggccatcgggcgcacgccgcgctgtcgccaggaagtgcacggacaaaccgtcgcgacgtccctcggcggctgccgaccggtccgcgccgcaggccagttgacggggattgactcgaccgggctggtccggctgacggccggatccgccggcaggcgagcggcggcgcggtccggcgtgaccgcgtccgcccgcgctcacgtcctcgcccgtaccggccgccggagcaggtagacggccgcggtcgagaccaggacggccatgcacgcgatgaacaccagccccgcaccctccaggccgatcggacccgtcagtacccccaccccgatcaccggcaccgagatgcccacgtacgccaccacgaacagcgtggagatcactgcggcacgccggtccgcgggagacgcctcggccaccgccgacagcgccccgcgaaacgccagcccctgccctcccccgccgacgagcgcgctcagcaccaccagcgacaacaggtcccaccgcagggcgcccgcgagcagcgccagcccggcgaagagaccggcacagcccagcggcaacgaccgccccaccccgacccggccgaccatcaactgcccggcggtcgaggcgaagaaggccagcgcgacgatcagcccgaccaccgcgcggttgtccacgccgagggactgctccaggaacgccgggctgaccgacgtgaacaccccgaacagggcgaaccccacgaacgatgcggtcgccgcgggcacgaacaccgcccgcacctgcgagggcagagcgggacgctgcggccgtaccgtgctcagcggccgcggctcccgaacggtctccggaagccacagcaggacggcggccgagccggccaccagcgcgaggtgcacgacgaacggcaggtacagcggccaggccgcgtactgcgcgagcacaccggcgagcagtggaccgcagcccagcccgcccatgttggcggccgtcgccacgaacgtggcccgggaggcgccgccgtacggtgccaggtcgatcacgtacaccgtggcggccccggtgaacaggccggcggacagccccgacagcagccgccccgcatacagccagcccagcccggtcgcgcacaggaaacagacggcgctcacggccgcgaatcccagacccgccagcagcaccggccgcctgcccacggcgtccgaggcgttgcccgccagcagcagcatgccgatgaccccgaaggcgtacacggcgtacacgacggtcaccgtcagctcggagaacccgaacttctcctgatagaggccgtagagaggggtcggcagcgtggtgccgaccatgcacacggcgaacaccgccccgctgagcaaacactggcgccaccctcggcgatcaccgtccatgccgccgacggtagtcccgcgcaccaccccgggccggccggccatgcccggcgcgccgcgggtacgggagattcgatcacgggtgactcgattcttgtcctgtgcgggcgcacttccgcggcacaggcaacccacaggtcccgtttcgcttccttcgaggcgcgaggggcccccggtaccgacggggcgcccgcgctcgaagtatgaggaggggacccttgaaccgcacccggcgaataggtgtcaccgccctggccgtgctcgcggccctggcgggctcaccggggctggcccaggcccaacagccgccccaggcaaagccgttgacagcggaggccgacagtccgctgccgccgggctggcgcgtcaccggggagggcgtcgcgcgggaactggtctggcggtcggacagggccgtgcccgtgggcgacgcccgcgtcgagttccacgcggacggccggctgctcggggtgccgaaggcggccaaggacggccacacgttccggctcgctctcggtagagccaccccgctgaaggaccttcaagtcctggcggccggacgccggttggacgcgcccgccggcaccaccggcaccaagaagccgaggaactccgcggcggccgcgcagcccccggcccggctcccggcgaactccgtggacccgggcaggccgggctcgtaccgcacggtcaccggcgagtacgacctcgacccggtgaagctgcccggcttcgcccagccggtcgagatgcaggccgtcgtcgtcgcacccgagggcgccaccggcaagcggccgctcgcgctgttcctccacggccgccacaccacctgcttcaagcccggtgggtccgaggacgacgtgaccatcgactggccctgcgcggccggcacgcagccgatcccgagccacaagggctatctgaaggaccagaagctgctggcctcccagggctatgtgacggtgtcgatctcggcgaacggcatcaacggccaggacggggacgccgaggacggcggtgcgcaggcgcgctcctcgctggtgcggcagcacctcgccaagtgggccggctgggccgcccacccgggctccgccccggcgggcgtgcccgacgcggccgaggccgacctgtcccgcgtcctgctcgtcggccactcgcgcggcggcgagggcgtcaaccgggccgccatggacagcctctacccgccgcccgccgcgcaggacggctaccggggcccggtgcgctggaagatccgcgggaccgtcctcatcggaccgacgatcttcggccagaatccggtcgccgacgtgccgtccacgacgatcctccccggctgcgacggtgacgtctccgacctccagggcgaggtgtacgtcgacgggacgcgcggggtcagccggggcaccgccctgcacagcgccgtctacgtggtgggcgccaaccacaacttcttcaacaccgagtggacgccgggcaagtccgaggcaccctcctccgacgacttctgggacgacccggaagggcagcccgacccggtgtgctccacgggcacccgcacccggctgaccgccgaccggcagcaccaggcgggcgcgacctatatcgccgccgcggcccggctgttcgtcgccggcgacgaccgggtgcgcccgctgctcgacggctcgggccggcgcgccccctcggccgacccggcccgcgtgctgacccacgcggtcggcgcccgccgcacgggcggcttcctgcccgacgcaccggtgaaggtgaccggcggcaggctgtgctcggcggtcgaccccgacccggccagggcatgcctgaaccccgacaccaacgggtcgtcgccgcacttcgcggggtggcagacggagaaggagaccggccgcggcgcggtcgcgctgaagtggtcgacgccgggcacggcggcgaaggtccgccccgccgctccggtgtccctctccggtgcgaaaagcctggcgttgcgcgtgttcgtgccgccgaacgcgaccggcaccaagctggacgtggccgtcaccgactcctccggccgccgggccaagctcggccgggtccaggccgacgggctgccgggctccgagcgcaccgcctcctactgggcgcgcgagctgcgcgtcccgctgacggcggccacccgcgccggtctcgacctgaggcacgtcaagtccctcgaactgaccccgcgttcacggtccgggcgggcctggctgatggatgcctggggctgggcccccggtaccccggcggccagggcggcgacactgccgcgcgtcgacatcggccggctctccgtcaaggagggcgactcgggcacccgtacgtaccacatcccggtccaggtctccgggcacggcagcggcaaggtccgcttctccgtcctcgacccgggcaccggacgggccaaggacaagctgatcacggtacggccgggcagcaaccccatcgacgtgcccgtgaaggtgaagggcgacacgcgcttcggctacgacgagcagaacgacctcatcgcgaaggccgtgcgcggcgccgtcatcggctcgtaccggggcggcgtcaccgcggtgaacgacgaccccgcgcccgcggtcaccatgacgccggtcacggaccgggtgaccgagggagggacgctgacgtggcggatctccctctccgagcccgccgacgtggacgtctggcagccggtccgggcgcttccggtcaccgagggcgccgagttgtccaccaaggacgtggacccgcagtggctgacggaccacaccggtgacctccccgacccggagcgcgcgctctccaaggcgaacgtgtgggtgtggacgagcattccggccggggccaccaccgccgacttcgtcgtgccgacggtgaaggaccaactggccgagccggccgagtcggtacgcctcgcgctgaccgacgacaacgccgagccgcttcccgaccaccccgtgcggacgggcacggtggtggacgcgccgtagaccgcccttggtagggggcatgggcagggtgacccatgcccatgccccctaccgcgcgggaagagccgcgcggctcagaccttcagccgggcgccttcccacgcggggtgctccggggggcatgatggcggctatggggctgtcgacgcggttcacggaactgttcggtgtgcaacacccgatcgcgctggcgccgatgggcggatcggccggcggtgccctggcggcggcggtctctcgcggcggcgggctcggcatgctgggcgccgggggcggggaccgggagtggctggcccgcgaactgccactcgttgcgcaggccggcggcaggccatggggtatcggtttccagacctgggcgatcgaccgcagcacggtcgagcgggcgttggagcacaccccccgggcggtgatgttgtccttcggggacccgagcccgttcgcggagtgcgttcgcgcggcgggcgctgtgctgatcgttcaggtgaccgatctggacgaggccaggcaggcggtcgacctgggcgccgatgtcatcgtggcccagggcaccgagagcggtgggcacggggcccggcaggggcgttccacgttgccgttcgtgccggtcgtggtggatctggcggcaccggtgccggtgctggcagccggtgggatcgccgatggccgcggtgtggcggcggccctggctctgggcgccgccggggcgctcgtcggcacccgtttccaagccacgaccgaggccctggtggacccctcgaccgccaaggcgatcgtcgagggacatggcggggacaccgagcgcaaccgggtgctcgacatcgcccggggctctcggtggccgtcgaagtacaccgcgcgcaccctcggccacccctacctcgaccggtggcggggccgggaagccgaactcgccggggacccccgggcccgacaggactaccagcgcgacgtcgcgcagggaaacatcccctcgctgccggtgtgggccggcgaggccatcgacctcatcaaggatctgccgtccgcggccgatctcgtcgccaccctggccgcgcaggcggaggacgcactcacccgcgcgggaagacgctgaccggagccgtccgcccggacgggggccgggccggcagcgccactcgctcccggcgtaccggctgcgcgcccgcacccgttcggtcaacgccggatccagatgcaaaggcgtccggcgtcagcccgccgcgggctgcggctcgactcggctcggctcggctcggctcgcccaagcacaccgatttctcccacccggagggcggtcaccgctcgtcggcgggcggtggagcggcggtgtcgggcttgggccgggcgggctgttcggcggtggtgaggggcgtccactccgctccggtgcgcagccggaaggcggcgacggcggcctccacggtggggaagaagtgccgggggtcgatggtgcgggtgagcccataccgttcgatcttgcgccgtacggggtccttgagctcggcgaacacgaggtgtacgtggttcgcgttgagcgtctcgtcgagttcctccaggacgtcggcggcggtggtgtccacgtccgtcatcggctccgccgcgatcacgatccagctcggccgcgggtccgcgtcggccagtcgcctgatctcgtcgcggaaggccttggcgttggcgaagatgagcggggcgtcgaaccggtagatcaccaggcccggcagttgcccggcctgtgggtaggagcggacgtcgtggtagccctccaggccctgcacccgccccagcacggtgttgtacggccaccaggcgcgtcggaagacgttgaggacggacagggccacggcgatggcgatgccttccaggacgccgagcagggccacgccggcgaaggccgcgatgcacagcaggaactccgtccggcgctgccgccacagtcgtaccgctcccgggatgtcggccagcgacagtgacgcggtgatcaccacggcggcaagggccggctgggggaggttgcggaacaggcccggagccagcacgagcatgaggacgatgagcgccgctccgacgaccccggtgagctgacttctggcccccgcgcgctccgccaccgccgtacgggagccgctcgtgctgaccgggaagccctggaagagaccggccgccaggttggccacaccgaacacgtcgtacgcggtcctgaccgtcacctcgacggtgaccgcgtcggccgaggggtagtcggccctcagccgcgccaccaagttccggatggacacgcattcgtcccgcgggccgggtgacgggacgttccgcggctccgcgggaccggcgcgctccatcggcccggggtggcggctcacggcctcgacgggaaggcgtgcgccgacttgaggagtccgctcttcgaccgtcatggccgcaccggtcccatgtcccacgacctccagaccgcagaaccccacctctcgcctctcgccactcgccactcgccactcgccactgtcgcgagagggtctctcgcgctcattgtctgctcgcccggacaagatcgctccctggggccggggggcgggaagccgtggagggaggcgtcggcgccgcggccggcccgctgatcgagggaactcgtcatcgtccccgtgcggcgggccacctactgctcacccggcgtggccgagtgcacatcgtgcgcccggttgcaccgtctggtgagggtcgtccggggcagcccgcccttcgccctcagctgccgcccacatcgaaaccgcccaactcgccctggctcaactgcccaaacacctgcggcggggacggcagaccctgatccgcaccgaacggcccggcgcctgggtcgctggagatcaccgacatgcccgacctgaccacttggccgaaggggatgcggctgatcgtcagaaaggaacgcccgcaccccggcgcccagttgcgcttcaccgacctcgacggactgcggctgacctgcttcgccaccaacacccaggcggccagctcgccgacctcgaactgcgccaccgcagaccgtcccgctgcgaggaccgcatccgaaacgcccgcgacaccggcctgcgcaacctgcccctgcacgacaccgcacagaaccggatctggctggagatcatccccctcgcactcgacctcctcgcctggatgccgatgctcgcactgaccggccaaacccgccgctgggaacccaagaagctccgcctgcgcctgttctccgccgccgctcagctcgtgaacaccggacgccgccaccggctccgcttcgccgtccgatggccctggaccgacgtcatcacccacgcgatcggcaggctccacagcctcccgatccccggttgaccagccacttcgaccgtcccgacgacccgcagcgtcttgcgggtgatcctgacctcctcggcggctctgccgagctcgtccagccgtgcggtcagctgcgcgatctgctctcccgtcgtctcggcctgcgcggcgatctcgcgttcccgttcttccagccgggccagcaccgccccgagggtcagctccccgccggtcatgtgctgcgccaggccgccacatcgatgtctcaggtttcccagagtccgacgccactccccgaaccgccgccgtcgatgcctgaacctcgacgcgactcatgtgatgagaacccgcgaccaaggcaaggcgcttccgctcgacatcccggtcgcagcggctgaggaaacgacggcccccgctcaatcactgcaaccgcaccccggcataacagcagttcaaacccctgtcagcagcatcactgcgtgacctgcaccgccactgccgaacgctgagtcagtgccaactatccctcttttgtgccaactaaaaatcctcgtcacacgtcgtacgtggccctgttacagtcccacgatcgcgttccaccgcttcgcgaactccacgcgctccgtggacgtgatgtcccgcgcgatcgccaggcgcccccgcatcgacgcgtccgggaagatcagcgggtcctcggcgagggcggcggtgtcctcgtccttggacgaggccaggatgtcctgggccgccgggacggggcagacgtaattgacccacgctgccagttcggcggcgaccgcgggctcgtagtagtggtcgatcagccgctccgcattcgccttgtggcgcgccagattggggatcatcagcgactccgcccagagctcggccccctcctgcgggacgacgaagtggatgtccggatcgtccgcctggagctggatcacgtcgcccgagtacgcctgacaggcgagcacgtcgccactggagaggtccttgatgtagtcgttgcccgtgaagcggcggatctggccgctgcgcacatgcttctcgacctggtcgcagaccctgtggaagtcgtccgccgtccaccgggtgatgtccacgccgttgccctgcatcagcagcgcgaacgcctcgtccaggccggacaggagtgtgacccggcccttgaggtcgctcgcccacaggtccgacacatgcttgatctcgcggcccagcttgcggcggttgtacgcgataccggtgatgcccgactgccacggcaccgagaacgtgcggcccgggtcgaaggccggcgagcgcagcagcggatcgaggtacctggcgacgttcggctggcgtgcgcggtccatttcctggacccagccgagccgtacgaagcgggcgcacatccagtcgctgatgacgatgagatcgcggcccgtctgctggtggttcatcagggacgggctgatcttcccgaagaactcgtcgttgtcgttgatctcctcgacgtagtcgacggagatcccggtgcgcttctcgaaggcctccagcgtgggacgccgggtcgtgtccttgtcgtcggtgtcgatgtacagcggccagttcgcccaggtcagccgcttgtcgctgacggacaggtccgcggcggcacggtcgccgggctgcacataggcggcgggcacgccacagccggcgagggcgccgagcgcggtggtgccgcccagcgcacgcaggagggagcggcgggagagcgagggcgtcctaggagtctggggcacccttgcagcatgccgcccctgtccgggggcgggcaatcgacgctgcgtcgagcacatccgctccggcccgacaccttgtcgatcattccgtggccgacggcaccggcagctgcaacagcaacagccggaccgcctgaccgccggaccggcgccgagaggaaacacccggggccccggacggatcatctcccgtccggggccccggcgttcacgccctcagccggccgacgacgtcagccggccggcgacgtcagctgtccagcgacgtcatcacgtgcttgatccgcgtgtagtcgtcgaagccgtacgccgagaggtccttgccgtagccggacttcttgaagccgccgtgcggcatctcggcgaccagcgggatgtgcgtgttgatccacacgcagccgaagtcgagggacttcgacaggcgcatcgcgcggccgtggtccttcgtccagacggaggaggcgagggcgtagtcgacgccgttcgcccactcgatcgcctgcgcctcgtccgtgaaggactggacggtgatgaccggtccgaagacctcgttctggatgatctcgtcgtcctgcttgaggcccgagacgacggtcggggcgtagaagtagcccttctcgccgacctggtgaccgcccgcctcgaccttggcgtgggcgggcaggcgctcgacgaagccggcgacctgcttcagctggttcgggttgttcagcggcccgtacagcacgtcctcgtcgtccggctggccggtcttcgtgtcggcggccgccttggcgagcgcggccacgaactcgtcgtggatggactcctggacgaggacgcgggtggcggccgtacagtcctgcccggcgttgaagaagcccgcgaccgagatgtcctcgacggccttggggatgtcggtgtcctcgaagacgacgaccggcgccttgccgcccagctccaggtggacgcgcttgacgtccttggcggcggactcggcgaccgacatgccggcgcggaccgaaccggtgatggaggccatcgccggtgtcgggtgctcgaccatcgcgcggccggtgtcacggtcgccgcagatgacgttgaagacacccttgggcaggatcgaaccgatgatgtcggcgatcaggacggtggaggcgggcgtcgtgtccgacggcttgaggacgaccgtgttgcccgccgcgagggccggggcgaacttccacacggccatcatcatcgggtagttccacggcgcgacctgggcgcagacgccgatcggctcgcggcggatgatcgaggtcatcccctccatgtactcgccggcgctccgcccctccagcatgcgggcggcgcccgcgaagaagcggatctggtccaccatcggcgggatttcctcggagcgggtcagcccgatcggcttgcccgtgttctccacctcggccgcgatgagttcctcggcccgctcctcgaacgcgtccgcgatcttgaggagggccttctggcgctcggccggggtctggtcgcgccaggccgggaaggccgcggcggcggccgccatggcggcgtcgacgtccgcctgcccggacagtggcgccgtcgcgtacgcctcaccggtcgcggggttgaccacctcggtggtccgtccgtcggcggcgtcacggaattcgccgtcgatgtggttacgcagacgacgcagctcggtgctcactgccgggcctccaaagttcgggagtacgagtgtccaaacgctgagacacccaccctaatccgtgcccccacgttttcaacacccccgatcccgccagaactgcgaaatccgcaggcttccctcacgtaaacaacgaatttcatcgatcgagccttgcgaaacaaacgactcctcgtgcacagtgaggtcgtggccagtcgaagcgcagaccagagggactcccgcgagtccaggaacggcactccccagctggatgccgtctccctcgccatcatcgggcagctccaggaggacgggcgtcgcccgtacgccgcgatcggcaaggccgtcggcctgtccgaggcggccgtacgccagcgcgtccagaagctgctcgaccagggcgtgatgcagatcgtcgccgtcacggacccgctcaccgtgggcttccgcaggcaggcgatggtgggcgtccatgtcgagggggacctcgacccggtcgcggacgcgctgaccgccatgtcggaagtcgagtacgtggtgatgaccgcgggctcgttcgacatcctcgccgagatcgtctgcgaggacgacgaccacctgctggacgtcatcaacaaacgcatccgggccctgcccggcgtgcgctccaccgagagcttcgtctacctgaagctcaagaagcagacctatatgtggggaacccgatagccgtgagcaaggacctcagccgaaccgcgtacgaccacctgtggatgcacttcacccgcatgtcctcgtacgagaacgcgcccgttcccaccatcgtccgtggtgagggcacctacatctacgacgacaagggcaagcgctacctcgacggtctctcgggtctgttcgtggtccaggcgggccacggccgcacggagctggcggagaccgcgttcaagcaggctcaggaactggccttcttcccggtgtggtcctacgcccacccgaaggccgtggaactggccgagcgccttgcgaactacgccccgggcgacctcaacaaggtcttcttcaccaccggcggcggcgaggcggtcgagaccgcctggaagctcgccaagcagtacttcaagctccagggcaagccgaccaagtacaaggtcatctcgcgcgcggtcgcctaccacggcaccccgcagggcgccctgtccatcaccggcctgccggccctgaaggcccccttcgagccgctggtcccgggcgcccacaaggtcccgaacaccaacatctaccgcgccccgctcttcggcgacgaccccgaggccttcggccgctgggccgccgaccagatcgagcagcagatcctcttcgagggcccggagacggtcgcggccgtcttcctggagccggtgcagaacgccggcggctgcttcccgccgccgcccggctacttccagcgcgtgcgcgagatctgcgaccagtacgacgtgctgctggtgtcggacgaggtcatctgtgccttcggccgcctcggcacgatgttcgcctgcgacaagttcggctacgtaccggacatgatcacctgcgccaagggcatgacctcgggctactccccgatcggcgcgtgcatcgtctccgaccgcatcgccgagccgttctacaagggcgacaacaccttcctgcacggctacacgttcggcggccacccggtctccgccgccgtgggtgtcgccaacctcgacctgttcgagcgcgagggcctcaaccagcacgtgctggacaacgagtccgcgttcctcacgacgctccagaagctgcacgacctgccgatcgtcggcgacgtccgcggcaacggcttcttctacggcatcgagctggtgaaggacaaggccaccaaggagacgttcacggacgaggagtcggagcgcgtgctctacggcttcgtctccaagaagctcttcgagtacggcctctactgccgcgccgacgaccgcggtgacccggtcatccagctgtcgccgccgctgatctccaaccagtcgaccttcgacgagatcgaatcgatcatccggcaggtgctgacggaggcgtggacgaagctctgacccgcgtagcgcggatccgcgtacctcagtccctgtaccccaggtccgcctaccgctgaaccgcatacctctgatcagctgatcaacaccggccccggtgccgcccgttcgagtgagaaagggcggcccggggccgcgtgctgtccggcccgacggccccgactccctagcgtgccaagtgaccgatcggccctgccttcgttcccccggacgggggacttcgcacggctcttccgatctgaaccgaggtgtacgcccatggtggccccgccggacaacgacgtgctctgggcacgcaccctgcacttcacacacaacggctcccccgcgctcaacggtgtctcgctcggtgtgcgcgtgggcgagatcctcgccgtcaccggcccgcgcggcagcggcaagacgacgctcctgcagtgcctggccggactgctcccgacccagcggggcgaggtctggttcaacagcacgccggtccacaccatgggcccgctcacccgcgaacggctgcgccgcgaccgcttcggctggatcgacccggcccccctgctggtccccgagctgaacgtatgggagaacgccgccctgccgctcatgctgcgcggcaccggccgccgccgggcgaaagccaccgccctggagtggctggagcgcctcgacatcggcgactgcgcccgcaagcgcccctacgcgctggtccaggccgagcggcagcgggtcgccatcgcccgcgcactggcccccgcccccaccgtgctcttcgcggacgagcccaccgccccgctgcacagcgccgaccgcgcccatgtgctgcggacgctcaccacggcggcccgctcgcacggcatcacggtcgtcctggccacggacgacgcggacaccgcggcgctcgccgaccggacggtggcactgcgcgacggacggcgcgtgcacaccgtccatctgcccccggtcgccgagacggaaggccgggccgcgtgctcgctctccgtctagcccgcggggcccaccccctggtccagctccgcagactgctggtcacggcggcggccgcgggcaccggcttcctgctgctgggcacgctgggctacgcgatggcgcacccggacgcctcggctcgctcggtgctgcggctggcgtggtgcgtggcgccgatggcggccacggtgtacttcgcggtcgccgtggcccgtacggacccgggcacccgcccgcgcccgggcctctcggcgatcggcctcggccccgtacgtctgatggccgtctcggccgtgaccaccgccctgtccaccaccctcggctcgatgctcgccctgctgttcttcctgcatctgcgcggcgatctgaccgggatgccgttcgacggggcggcggccgagttcctcgccgcggaccagcccctgcccctgccgggggcgctcaccctgctggccctggtgccactggcggcgtcggtcacgagcgcgctggtgctgcggccgcggggcgagaagcaggcccgtatgtccggcacgtccaccacggccggcacgtccccgacgatcggcacgccccttaccgccggcgcgtccgcgacggccggcacgcccaccaccgcaggcacgaccccgacggccgacactccccctgccgccgacacggacagcacgtccaccgcacccgggacagccgccgacagccccaccccctccgccgcaccctcctccgccacaccgcacgacgtcccggccgagccactggacccgcagcgccccgccgtgccccagccggcccccggcggtctcccctggagcgtggccgtgctcgccgccggtctcgccgtcgagatgtacgcgagccagtcggggcccgcgcccggcctcgccctgccgggcaggttcgcggacggacccgccggggtgctggcgggctggacgctcaccgcaatgggcctcgtgctggccgggcccgcgatcacgtatctgtgcgggtggctgctccaggccctacgtcccggcgcgctgcgcctgctcgccgggcgcgtgctccaggaggaggcacggcggatcgggcaaccgctcggcgtggtgtgcgcggtggcgtcgggggcgtacgcgacggcgacgctgtacgccggggctcggccgtccttcgggccgctcagcacgctgggcgcgctgctggtgaccggctgcaccgtcgcgacgctggtgacggccgcggtggaggccaagcacgcgcgcgcggagaccaccgcggcgctgctgcggctcggtgcgccggccaccatgctgcgcagcgcggcgctgctgcgcgccggcgccctggtcgccgtgttcgtcccgctgacctgggcggtcgccgagctggcggccatgccgctgacgggctgagcggaaatatggccggcgagcgatgagtttcgcggcgacgcacggtccacctctccgtacggcacaccacaccaccgggagagacccctcatgtaccagcagatgatcttcgtgaacctcgccgtcgacgacgtcgacgcctcgaagaagttcttcacggagctcggctacacgatcaacccgcagttcacgacggacgactgcgcatgcgtcgtgatcagcgacacgatcatcgcgatgctgctgagcaagcagcgctacgccgacttcaccaagaagcggatcgccgacccgaccacgaccagcgaggtgctgctctgtctgagcgccgagagccgcgagaaggtcgacgaactggtcgacaaggccctcgccgcgggcggcacgagcagcggggagacccaggatcacggcttcatgtacggccgctccttcgacgacccggacggccacacctgggagatcgtgtggatggatccggcggcggtccagggctgaaatccgggagtgcctagcatgggcgggtgcagccgataccttcacccaccgcttcccacgaccgtgagatcgagtccctcgaggagttcgacgaggtggtctcggagcgcggctccctcgcccggtaccgcgtacaggccgtcgatctgacggcccgtacgcgggcgctgctcaccatggactgcgcgggcgccgtcttcctgggctgcccgatggaccccgaggcggcggcgcgcgtacgggccacgggcgcgctggtcttcccgccggtcccgggcctgcccttcgacccgtaccgcggtcggctctacaccccggacgagctcttcgactcgctcgacaccgactacgaggcgacgcccgacgcccgcgcgtacgcctggttccagcggacgaaggccgacggcgacatcttcgcgtcgatggtgcgcgcgatccacgacgacgccgtctcggacgccctcgacgaactcctcgtcggcgcgcgggtggtgggcgtgatgggcgggcacgccatggcacgcggcacgcgggagtacgagggcgcggcccggctcggccgtgaactggcgcgcgccggtttcacggtcgccaccggcggcggcccgggcgcgatggaggcggcgaacctcggcgcctacgcggcccccttcgggcccgagatgctcaccgaggcgctccaactcctcgccaaagcaacgtcgttcacaccgtccgtgaccgagtgggcgcgcgccgccttcgacgtgcgcgagcgctggccggccggcggcccctcggtcggcatccccacctggttctacggccacgagccgccgaacgcgttcgccgcgcacgtcgccaagtacttcgccaacgcgacccgggaggacgggctgctggcccgctcgaacgcgggcgttgtgttcctgccgggcgccgcgggcacggtgcaggagatcttcgacaacgcgacccccaactactacgagtcccggggcgaacccacgcccatggtcctcgtcgaccgcacccactggaccgagcggctgccggcctggccgctgctccaatccctggcgcgggaacgctcgatggagtcccgcatcgccttggtggaccgcatcgaggacgccccgggggctctcaaacgcctcggtggttaatgagcgggcaaagccgacgggcatgccggacatgcgcattgacagtgcttacccgtcgcttataaacctgtgagactcctgggggtgctgttaccgcacgcaggacctcccaaccccccgcagttgtacttcctgtgaagggcaatcgtgtccatatctcgccgtaccgcacgttctgtgcgaatcctcggagttgcctccgccacggccgcgctcgcgctcggcgtcgcgggcaacgcaatggcctgcaacatcagtgagttctccgccgaagccaagtgcgacggcaccaagagtgtcatcaccgtcaaagacgtggacccctccggcgtacccgcggtcgtctccgtgttcctcgagaacaacggcgccgacgtgaagaagatcggcgagcaggaggtcaagggctcgcgcgaaggtgtcaccatcaccttcgacgaggcctggaagccgaacgccgaataccgcatccacgtcaaggccgggaaccaggtcgacgaggacatcaagccgaacctgaccaccccggccacggcgtgcaagacggagacgaccccgccggccaccaagaccccgaagccgtcgaagaagccgtcgtcctcggcgacgccgtccgcgaccccgtcgacgtcggacagcagcacgccgccggccgcctcggacaacgccccctcgcccgcggtcggtgagtcgaacctcgccgagaccggtgcgaactccaacaccggcatgatcgccggtatcgccggcggcctggtcgtcatcggcggcggagcggtgttcttcggcatgcgccgccgcggcgcgtcgaaggccggctgacacctccgcaccacctctcgtacgcacctgtggcccgccccttcagcaggggcgggccacatgtctgtcccgctcgtcgagagcaaccggcccgggcgcgtccggcgcgcgatccgcacgctatgcgccggaagcgcctccgagtacgacgatgtcggccacgtcgaacgccaccccgaccgtctccccgggctccggcgcgtcccgcagcgcgcacgccgcttccagtcgcggtgcgtcgtcctccggctggaggtgcacggcgacatgggtgccccggaacgtgcgggcggccacggtgcagcgaagcccctcggtggcatccgccagccgcacgccggcgggcctgacgagcagcgtgcccggcccctgcggggacccctccggcaccgggaccttgccccacggcgtgtcggcggcctccccggcgacggtcgcaccgaccacgttgtcgaagccgaggaagcgggccacgaactcgtcggccggctgccgccacacctcaaggggcgtaccggactgggcgatccgcccggcgcgcatcacgacgacccggtccgcgagcgcgaacgcctcgccctggtcatgggtgacggcgagcacggtcgtacccagttcggtgaacagttcccggagttcgacgaccaggcgttcacgcagcgaccggtcgagctggccgagcggctcgtcgagcatcaacagccggggacggggcgccagcgcgcgggccagcgcgacccgctgctgctcgccgccggagagggaggcgacggcccgccgcgcggcgcccggcagcccgacgaggtcgagcaactcccgcacccggccctcctgttcggaccgcgaagccccgtgcatacggagcccgaaagcgacgttcccgcccacgtcccgctgcgggaacagttgatggtcctggaacatcagacccaccccccgcttgtgcggaggcaccgagtccatcgcccggccccccaggaccacctgtccctcgtcgagcggctggagcccggcgaccgcccgcaacagcgtcgacttgccgctgccgctcggcccgagcacacacacggtctcgtgctcggcgacatcgaggtcgacggcgtcgagcacggcccgcccgccgaagcgtacggtcgcggccttcaggctcagcagcatctagaactccccggtccgatcggtacggacgcgctccagcaacagcagtgccaccgcgcacaccaccatcaagatcgtcgaaagggccatcgcctgcccgtagttgaggtcacccgcgcgtccgaggagccgggccacggcaaccggcagcgtcgggttgtcgggccgcgcgatgaagaccgtcgcaccgaactcgcccagcgacacggcgaaggcgaacccggccgcgaccagcagcgcccgccgcaccatcggcagatcgacctcgcgccacacccgccacggcgaggccccgagcacggacgccgcctcgcgcagccgttcgtccacggcgcgcaggacgggcagcatggtgcggacgacgaaggggacaccgaccagcgcctgcgcgagcggcacgagaatccacgagccgcggaggttcagcggcggcttgtcgagggcgatcaggaacccgaagccgacggtcacggcggacacgccgagcggcagcatcaacagcgcgtcgaaaccacgcacgagacggccggcgtcgcgccgggtcagggccgcggcggccagcccgccgatcagcacggcgacggcggtggcggcgagcgcgtactgcagagaggtgccgatggcggtgatcggtgcgacgaggaaggtcccgccgtcgtcgtgcgtcagcgcccggtagtacgcgaatccgtggccgccgggcgcgtcgaacgagcgctggacgagaacggcgagcggcagcaccaggagtacggcgacggtggcgaggacggcgccgagcagcgcccactgtcccgccccgcgcggcctgcgcgccgtcatggatgcgtccaccagccgcagcgcggcctcccgccggcgcacggtcccggcgtgtacggcgaggatcgcgccgaccgccatgaactggatgatcgtcagcacggcggccgtggcgaggtcgaagatctcggaggtctgccggtagatctcgacttcgagggtggagaaggtgggaccgccgaggatctgcaccacaccgaacgaggtgaaggtgaagaggaagaccatcagcgcggccgccgccaccgccggggccagcgccggcagcgtcaccttgcgccaggccgcgaaccgggaggcgccgagcatccgcgcggcttcctcctgacgcgggtcgagctgcgcccagagaccgccgacggtgcggacgacgaccgcgtagttgaagaagacgtgcgcgagcaggatcgcccagacggtggtgtcgagccgtacgccccacagctcgtcgaggagtcccccgcggcccacgagggccaggaaggccgtaccgacgacgaccgtcggcagcacgaacgggacggtgacgacggcccgcagcacctgcttgccccggaaatcgaagcgtgcgaagacatatgcgccggggagcgcgatcagcagcgtgagcgctgtcgaggcgaacgcctgccaggtggtgaaccacaggacgtgctgtatgccggactgcgccagtacgtcaccgatccgcccccactgccaggccccgtcggccttcagaccacgcgccacgatcgccgcgacggggtaggcgaagaacaccccgaagaacgcgacgggcagggccatgagcccgagccgcgccgcgctcccacgggagagccccttgcgcgccgggggctctacttcagtacgagcgaggtccacgacttgacccactggtcacggttgtcggcgatctcggccggggccagggtctcggggctcttggccgccggaccgaactcgctgaattcggcggggacctgagcacccttgaccaccgggtacacgaacatgttcagcggcatgtcctcctggaattccttggtgacgaggaagtcgaggagcgccttgccgcccttggtgttcttcgcgttgctcagcagccccgcgtactcgacctgccggaagcaggtcccgctcgcgaccccggtgggcgcggtcttcggcttggggctggcgtagatcacctcggccggcggggacgaggcgtaggagacgaccagcggccggtcgcccttggccttcttgccgcctgctgagcccgagaactcctggttgtaggcctgctcccagccgtcgaccaccttcacgccgttggccttgagcttcttccagtagtcgggccagcctttgtcgccgtactcggccgccgtccccagcaggaagccgaggccgggcgaggacgtggcggcgttctccgtgacgagcaggttcttgtaccgcggctcgaccaggtcgccgaaggaggccggcgggtccagcttgtggtcggcgaagtacttcttgtcgtagttgacgcagatgtcaccggagtcgatcggtgtcacccggtgcttggcccggtccacctggtactcggggcggatcaggccggagcccttggcctcgtacggctggaacagcccgttgtcgagcgcccgcgacagcagggtgttgtcgacgccgaagaagacgtcgccctgcgggttgtccttggtgaggatcgccttgttgaccgcctgcccggcgtcgccatccttgaggaccttcaccgtgtagccggactgcttctcgaagtcctcgagcacgctcttcgaggcggcccacgagtcatggctgaccagggtcaccgtcttggagtcggcgtcgccgccgcccgagccggacgagccgcacgcggacagcgtgacgagcccgagcccggcggccagggccgcggccgtgaacttcttggtggtgctcaccgaattcctcctggagtgaccaggagaagacgcggccctgcccgggagcctccgacgagttcccgggcagggcgcaacagcttgagtgatgaccgaacttcctacccagaatgacctgggcgaggttcagagggtctgcggactctcccgcactctcagcgctgtggcgctcccctgtcggaatatgaagatgtacctacgcgggacaggttaccgctcggtggccgcgagctggccgcaggctccgtcgatctcctggccacgggtgtcccggacggtgaccggcaccccgtgggcggcgatcgcctcgacgaacgccttctcgtcctcgggccgcgaggcggtccacttcgagccgggcgtcgggttcagcgggatcaggttgacgtgcaccggcctgcccttgagcatccggccgaggcggtcaccgcgccaggcctggtcgttgatgtcccggatcagcgcgtactcgatggagagccggcgtccggacctggccgcgtactcccagccggcgtccagcacctcccgcaccttccaccgcgtgttgacgggcacgagagtgtcgcgcagctcgtcgtccggggcgtgcagggagatggccagccggcacttgaagccctcgtcggcgaaccggtggatggccgggacgagcccgacggtcgacacggtgatgccgcgctgcgacagcccgagcccgtccggctccgggtcggtgagcgcccggatcgcaccgacgacccgcttgtagttggcgagcggctcgcccatgcccatgaagacgatgttggagagacgggcggggccgccgggaatctcgccgtccctgagcgcccgcatgccgtccacgatctggtgcacgatctcgccggtcgacaggttccggtccaggcccgcctgtccggtggcgcagaacgggcagttcataccgcacccggcctgggagctgatgcacatcgtcacccggtccgggtagcgcatgagcaccgactcgacgagcgtcccgtcgaacagccgccacagcgtcttgcgggtggtgtcctggtcggtcgacagatgccgcacgaccgtcatcaggtcgggaagcagcgcctcctggagcttggcgcgggaaccggcggggatgtcggtccactgctccgggtcgtgcgcgtaccgcgcgaagtagtgctgcgagagctgcttggcgcgaaacggcttctcaccgatcgcggcaacagcctctttacgctcggcgggcgagagatcggcaaggtgccgcggcggcttcttggctccgcgcggggcgacgaaagtgagttctccgggcttaggcatggctgtaccagtgtcgcagatcgaatcgggtgacctgggggccgagccggttgcgctggtcacccctcatcaaccccctcgtcgcccctggtggcctccggtcgcccccggtcgtcgtgggaccttctcgggcggcccaaagacggcccccctgggagaaacgcaaaaggcgggcaccggattgtgtccgggcccgcctccacgggatgtcacggtcgtcacgggtgccggggacgcccggcccagtgcgtgacaagaaccgcatcacgcaaggaaaagcgatccttaagcgacggtgtcctcttccttgcagttcttcggggcgtaaccggccttcgtgttacacgccttgatggtcaccttggtgccctcggcgaggttgccggtttcccagtgggtacagaaatccgagggaacgccgctcgtcgaaaccgtgcggtcccacgttccgttcctgccgacatccaggtaggacgtgacggcccacccgtccgccgtccagtcacaggcccggatggcgtcaccgggagtgttggtgctttccaccgggtcctggttgaaattgccccagtcctggaacgagttgatctgcaccgcgatgagcaggccggtgccggcctgcgccgggctggcggcagctccgaggaacgtcgcggcggcaattgcagtgactgccggaatcgctttcaagcgcaagacggaaatccccttgaattgtccaccacgggctcttcaggacagcagaaaccacagacctcacagagatggcccgtaacggtaattcgctgacttcccccgcgcccgaacccgtggtcatgtggtcgaatttggcgcttgatcatcaaaacttactggcccgaacatgtcaagaagtttacgaaagcacctccgggcatacgggaaggggccggctgccccatggacagccggcccctctccggaaaaagcgcaggtcagccagaccctacgaagatcaccagcaacaaccacaccaccggagccgtcggcagcagcgagtccagccggtccatgatgccgccgtgccccggcagcagcgtgcccatgtccttgatgcccagatcccgcttgatcatggactcgccgaggtcgccgagcgtggcactggcggcgaccgcgaagccgagcacgaggccctgccaccagctgccgtcgtcgatcaggaactccatgcacagcgcgcccgccaccatcgcgaacgagaccgctccgaccaggccctcgcgggtcttgccggggctgatgcgcggggcgagcctgtgcttgccgaaacgccagccgatcgcgtacgcgcccgtgtcgctgaccacggtgagcagcaggaacgtgagcacccggcgcggaccgtcgtcggccgtgagcatcatcgcgacgaacgtcgccaggaacgggacgtagaacgccgcgaagaccccggccgtgacgtccctgaggtagccctccggtggttccgtcatgcgccagaccaggacggcgagcgcggtgagcgccatcgccacccacgcgccctcggcaccccggacgtatccggcgacgaccatcgccgcgccgccgaccgcgagcggtacgaggggcgccttgatgcccttgcgctcctcgagccgtgaggtgagctcccaaaggcccaccaccacggcgaccgctatgaccccgacgaagacggccttgacgacgaacaacgacgcgacgatcaccaccccgagcccgacgccgacccctatggccgcacccaggtcacggcccgcgctcttcttctgcggggcgggcgctggctgtggggcgtcgggcatgggctccggcttctggggctgggccccatggggcgtctgggacccatagggcgactgagtcacgtacggcgtctgtgacccgtaggacgtcgtctgcggcgtgtcgtcgcggaacaaggggccactcagccgagcggccccccggtcgtcatcctggtctccgccatgcgcgggtacgtcgggcacgatgggcatggggcgagtctgctgcgcgtcatgcgcatcgtacgtgggacccgccggggctgccccctgggcaggcccctggtcggacggcccccagtacccggcttgtggcggcgccccccaggaagattcgttcatcagacctcgagcagctccgcttccttgtgcttgagcagctcgtccacctgggcgacgtacttcgcggtggtgtcgtcgagctccttctccgcacgacggccctcgtcctcgccgacctcgccatccttgatcagcttgtcgatggcgtccttggccttgcggcggacggagcggatcgagaccttggcgtcctcacccttggtcttggcgaccttgatgtagtccttgcggcgctcctcggtcagctcggggaacaccacacggatgatgttgccgtcgttgctcgggttgacgcccaggtcggagtcccggatggcctgctcgatgttgcgcagcgcgctcttgtcgaacggggtcaccacggccatgcgcggctccggcaccgagaacgaggccagctggttgatcggcgtcaacgcgccgtagtagtcggccacgatcttgttgaacatcgccgggtgcgcacggccggtgcggatcgcggcgaagtcctccttggcgaccacgacggccttctccatcttctcctcggcctcgaggagggtctcttcgatcaccacttgctcctgcgtgtcttgagtaggcccggcagcggtccttgtcggtccccggccggctgcgtcgcgtcttcttcctgcacggttccggaccggcaggacattgtccatcccccggtcagggtccatggcccaaagaggggtggtccccggtcagtcccggctgccctggtcacccacgagtgtgccgatcttctcacccttgacggcgcgcgcgatattgccctccgccagaagttcgaagaccaggatgggcagcttgttgtcccggcacagcgtgatcgcggtcatgtcggcgaccttcaggtcgcgggtgatgacctcgccgtagctgagcgaatcgaacttgacagcctcggggttggtcttcgggtcggagtcgtagaccccgtccacgccgttcttgcccatgagcagcgcctcggcgtcgatctccagagcacgctgggcggcggtggtgtcggtggagaagtagggcatgcccataccggcgccgaagatgaccacacggcccttctccaggtgacgcacggcgcgcagcgggatgtagggctcggcgacctggcccatggtgatggcggtctgcacgcgcgagtcgatgccctccttctccaggaagtcctggagagcgaggcagttcatgaccgtgccgagcatgcccatgtagtcggagcgggcccggtccatgccgcgctgctggagttcggcgccgcggaagaagttgccgccgccgatgacgacggcgatctcggagccgtcgcgcaccacggccgcgatctcacgggcgatggcgtgcaccacgtccgggtcgacgccgaggccgccgcctccggagaacgcctctccggacagcttcagcaggtaccggccgcgtactttgccgtcgtcgctcttgtcggccttggtggtcatggagatctcgcctcttttacgtgtcgcacatacgaagaaggccattgccgatggggtgtcgttcgcatcccatacgcggcaatggcctcctcgtcagatctgctgtagtccgccacgcgcgtgtgcggggtggcatacgcgaatgacgcagtcgactgctgtcgaccctagcggggtcgcgcgtcgatcgcggtacggactcagatgccgaccttgatgcgcgtgaagcgcttcagggtgacacccgcctcgtccagaaccttctggacggacttcttgttgtcgagcgcgtacggctggccaagcagcgtggcgtccttgaagaagccgttgaggcgaccctcgacgatcttcggcagggcggcctcgggcttgccctcggcgcgggtggtctcctcggcgacgcggcgctcggactcgacgacctcggccgggacgtcctccttggagaggtacttcggcgcgaaggcggcgatgtgctgggcgacgcccttggcgatctccgcgttcggcttgtccagctcgacgaggacaccgatctgcggcggcaggtcgggcatcgtgcggtgcatgtacgcggacacgtaaccgtcggcgtaggccgcgaagcggtccaggacgatcttctcgcccaggttggcgttggcctcgtcgacgaacgcctggaccgtcttgccgggctcgatctcggaggcgagcagcgcctcgaggtcggccggggcggtcttggcgacgtgctcggcgatcgcgttggcggcggcctggaacttctcacccttggcgacgaagtccgtctcgcacttcagctcgaccaggacaccggaggcgttgtcgtcggcgatgacggagaccacagcgccgttctcggcggagcggccctcgcgcttggcgacgcccttctggcccttgatgcgcagcgcctcgacggccttctcgacgttgccctcggcctcgtccagcgccttcttgcagtccatcatgccggcgccggtgagctcacggagcttcttgacgtcggcggcggtgtagttcgccatgattcctggaatctctctcgaagtctgaagatctacgggccgaacggcgggggctttgtgggcccccgccgttcacaacccgaaggggtgagggggtcaggcctgctcggcgtccgcggccggggcctcggcagcgggggcctcagcggcgggagcctcggcagcgggggcctcggcggccggcgcctcagcagcggcctcggccggcttctcggcctcggcggcggccggagcctcagcctcgtcggccttcttctcgccctcgagcaggtcgcgctcccacgcggcgagcggctcgcccgcggccttgtcaccctcggccttgccggcgccggagcgggcgatgaggccctcggcgacggcgtcggcgatcacgcgggtgagcagggtgacggagcggatcgcgtcgtcgttgcccgggatcttgtagtcgacctcgtcggggtcgcagttggtgtcgaggatggcgacgaccgggatgttgagcttccgggcctcgccgaccgcgatgtgctccttcttggtgtccacgatccagacggcgctgggcaccttctgcatctcgcggataccaccgagggtcttctccagcttggccttctcgcgcgagagcacgagaagctccttcttggtcagaccggaagcggcgacgtcctcgaagtcgatctgctcgagctccttgaggcgctgcagacgcttgtagacggtcgagaagttggtgagcatgccgcccagccagcgctggttgacgtagggcatgccgacgcgggtggcctgctccgcgatggcctcctgcgcctgcttcttcgtgccgacgaacatgaccgtgccgccgtgggcgacggtctccttgacgaactcgtaggcgcggtcgatgtacgacagcgactggagcaggtcgatgatgtagatgccgttgcgctcggtgaagatgaagcgcttcatcttcgggttccagcgacgggtctggtgaccgaagtggacgccgctttccagcagctcccgcatcgtgacgacggccatggccgttctccttgagtttctcggttgtgccgcgtgtgccggacggcactcgcgcctgacgcccgcgtgcgccttgccactaaggaccgagaggcgctgacttcggctttcgtctctcgacgggaggccgttgtcggggcgtgcgaagtcgacccggtgacccggatcgccacaagaagtgtacgggacccgcgaggtgccgggtgacgccgctgtccacaaccggcgagtactccacagatcccggccatggtcgacgtggatgcgggaccgttctcgcatgcgagcgaaacgatctgtgcgtacgtggccggggttgctgctggtcctgacggtgaccgtcctgggcagcacggcgtgggcaagcggggacatgaccgcgcggcgaacgggtgcctccccggggccggaggtgtcgcgggcggcgggcgcgccgccggggacgggcgctcctccagggggtggcgcgcccgcgccaccggaggccgatggcgcggttccggcgatcggccgcgcgtggcccgtgggtgtacgcccgttggtggtacgcggctgggagcctccggctacggcgtacggccggggtcaccgtggcgtggacctggcggcggcccccggcactccggtgcggtccgtcgcggccggccgggtctcgttcgcgggccgggtcgccgggcggggagtcgtctccgtcgagctgacgggaacgggcgagccgcccctgcgcacgacgtacgaacccgtacgcccgtccgtggagaagggcgacgaggtggcggcgggcgggagcctgggcacgctggagccgacgaccgcccactgctcgacggcctgtctgcactggggcctgctcagaggccggacctacctgaacccgctgtcacttctgcccgcgtggctgctgcaccgaggcccgtcccgcctgctgccggtgctcggggtgcccttgcctcgtgcgtagccccagtccgcgacacctcatccgcggccctgtcccacgacacctcatccgcggccctgtcccacgacacctcgtccgtggctcagctcgcggtctcagcgctcgtccgcggcctcagccccgaactcctcgcagggccatggccacggcggcgtcggtgatcgccgcgggatcctcggcggcccccagctcgatccgccgtaccgcggcgtcgaccacgccctggaggagcatcgcggccagcctcggctccgcatgacccatctcccccagcgcctgcacgatcatcgcgacgagcccgccgtgggccgcacggatcttctcgcgcgccccggcgtcgagctcgccggcggaaatggcgaccacggcccggtgccgccggtctccgaccagggccagctgctgccggacatacgcctcgaccttggcctccggggtgtccgcccggtccatcgccgccgagacctccgccgcccagacggggaagtcgaccgcgcacagttcctcgacgacggccgcccgcgaccggaagtactcatacacggaggagcgcgcgagccccgtgcgctccgcgagggccgggaaggtcagcgcctccgtcccgccctcggacagcagggaccgagccgcgtccagcagggcggctcgctgcatcgaccggtgctcggccacggaggccgctcgaatccttggcacgcgtccactttacggacggaccgccgcggaggggagccactccggccacacactccgatgcggccccgatgcggctctgctcggcggcagggacgattcagcagctccggacctctcccccgcccggatgacgcgcaggcctcacccggccgcacacccccgtcagcgaccgaagctcgccagtttggccctgagctggagcacggacttcgtgtggatctggctcacccggctctccgtcacccccagcacattgccgatctcggcgagcgtgagcccttcgtagtagtagagcgtgaccacggtcttctcccggtcgggcagcgtgttgatcgcccttgccaggaaccgccgcagctcccggtcctcggccacctccaccgggttgtcggcggcggtgtcctccagcgtgtccatcaggctcagccggtcgccgccctcgcccccgacatgcagcagctcctccagggccaccacgttcgccagcgacaactggctgaacacggagtggagttcgtccaccgcgatgcccatctcggtggccacctccccctccgtcggggtccgccgcagccgcgcctccagcgtcgcgtacgcccgctccacgttccgcgccttctgccgcaccgagcgagggatccagtcgagcgcccgcagttcatcgatcatcgcgccccggatccgggtgatcgcgtacgtctcgaacttgatctcccgcccgatgtcgaacttctcgatcgcgtcgatcagtccgaacaccccggaggagacgaaatccgcctgctccacattgggcggcagaccgacgctcacccggccggccacgtacttcaccagcggtgagtagtgcaggatcagctgctcccgcagccgttcgtcccccgtcgccttgtacgaccgccacagctcgtcgagcgtcgagggagcgggcgggcgcacgctgccgccgtcgcgggcggctgggggaatcgccgcccggtcggacccggaggtgtgctggggcattcgtcgccttgtgccgttctgccgtgaactggggatgcctgggtgacctgtcggtctgatgtcgagatgcctgcctgattcggaattcatgtgagcgtagcgtgactgaagtgtcgcagtgcgcgaagggcgagggatcacccccgcgcgagcccgctccgccgagcgccgcccggggtcccgcccattgccctgcgtgaccgccgacggtggccaactaagggaattgccaagggtgtcggggagtcgcccggacggccgtacacgctcggtcagcatcggccgcgatcttgggagaccgagatcagcgcctggcgtgtcaacttccagcgatcgccgtgtcgttcgacgaaaccaagtgatcggagttcgtacagtctcccgaccgcgtcgtcacccgtcgtgcccgctccgcgagcgatctcgtccggcgtcgcggtcccgtggcccggcagcgcggccaggacgcgggcggcgcccggctccagcaggtcgcgcggcaggacggggcctcgccggtcgggggccagctcgcccatgtcacccaccagttcggccacctccgcggcatcggagaccaggacggcgtcgccgcgcagcaactcgtgcaccccggcggagagcccgctggtcaccggccccggcacccccatggtgaaccgcccgagccgctgggccgcgcgtgccgtgaccagcgcgccgctgcggtaggccgcctcgacgaccacggtgccccgggtgagcgcggcgatgaccctgttgcggaggatgaacctgctcggcgtcggatggtcgccgggcggcaactcccccacgaccagaccctgttccgcgatcctggtgatcaactcggtgtgtccgcgtggatagggctggtcgactccgcaggcgagtacggcgacggtggccccgccggccccgagcgcaccccggtgcgcggcaccgtccacgccgtatgcgccgcccgacaccaccacccatccgcgctcggcgagtcccgcgccgagggcggccgccatgtgggcgccgtactcggtacaggctcgcgcgccgacgaccgcgacggaccgcagggcccacatccgcaggctcggccggccacgcacccagagcccggtggggcgggcgtccgcgaggtcgtcgagctgtgccggccactccgcatcgcccgggcagacaaagcgggccccggcctgccgggcctcggccaggtcccgctccggcctggcctgggcggcccgtcctctcagccccgcccagcgcttggccgacacccggggaaacggctcgcctccctccaccagccgccgggcaaccgccacggcgccgtactcccgcagccatcggccgccgatctcgtcaccgggctcgatgatccgcgtgagggcgacacgggcgagccgttcgtcgtccgtcatgccgacgcgccgatcatcatgggcacgccccggggcaccccggtgcgcaactgcagggccagggccacatccccggcgtcgggcctgtcgtgcccggacagatccgcgaccgtccacgccacgcggagcacccggtccaggccgcgggcgctcagcacgccccgctccagtccccgctccgcctcctccatggctcccggcacggcctgccagtggctgcgcagctcccgtccgggcacttcgctgttggtgcgccagggtgtcccggtcaaccgcgtcgcggagcgctcacgggcggctcgcacccggtcggccaccgcccgcgtcgactcgccccgggccccgcgcaccgtcagctcggcccgcgtgaccggctccacctcgaccctcaggtcgacccggtcgagcaacggtcccgagagcctggcctggtagcggcggatcgtcgcgggcgggcattcgcacagggtgtcccgttgcgacaatcgcccacaggggcacgggttggccgcgagcaccatcaggaacctggccgggaaccgcaccacgcccgcactgcgtgcgatcaccacatgccctgactccaggggctgccgcagcgcgtcgagagcctggccgctgaactccggcgcctcgtcgaggaagagcacccctcgatgagccagcgacaccgcgcccggccgggcgacgccctggccaccgccgaccagtgcctgcatcgtggccgagtggtgcggggcgcagtagggagcggcgtccaccagaggtttgcccccaggcagcagccccgcgaccgaatgcaccgcggtgacctccagcgactcgtcccggccgagccgtggcaggaccgtgggcagccgctcggcgagcatcgtcttgccggctcccggcggcccttcgaggaacagatggtgaccgccggcggcggccacctccaccgccgtacgcgccgagagctgcccgaccacgtcggcgaggtcatggccgaggtcgagaggcgcggcgcccacgctgtggatgccggtggccgcgccggtaccgggcatgcgcaggcccgccagcagcggatccggccgcccctgctcgtcggggtcctcttcggggaacggctcatccgtgagcacggcgaccagctgccggaggctgcgtacaccgagcacggacacgccggggaccagcgaggcctcggccgcggcgcactccggcaccaccacctgttcgtaccccgcgtccgctgcggccaggaccgccggcaggacgcccctgaccggccgcaccctcccgtcgagcccgagctcgccgatcatgacgatgtcggccagcacacgcgggtcgatgcgctcggcggcacccagcacggcgcacgcgacggcaagatcgaaccccgagccgcccttcggcacggatgccgggctcagacccaccgtcagcttcttctggggccactcgccgccggagttgaccaccgccgacctgacccggtccttgctctccgtcaggctcttgtccggcagccccaccagcgtgaacgccgcgaccccgggctccaggcccgcctggacctcgaccaccacgccctcgacgccgaccagtgccaccgaacacgtacgggcgaatcccatcacgccaccccccgcacatgctccacgacgggtgcgccgcggtccggcaggaggatgccgaccaggtcgatacggacgcccccgggcggagcgcctccgtgttcctggacccagcgctcggcgagaccgcgcagacgctccgccttcgccggtgtgatcgccgccatcgggtgttcgaagaggcctgcccggcgggtcttgacctcgcacacgaccagcgcgtcgccgtcgcgggccacgatgtcgatctcgccggtcctgccgccgcgccagttgcgctccaggaccgtcatcccggactcggtcagccgccgtgcggccagcgactcgccgtacctgccgagtgcgccgcgttgcgcgctccgccgtgcgccttgctcggtgccctgccgcgcgccgtactccgtgtcctgccgcgcgccgtgctgtgccttgcgtgtgctcatgtcggcaccacctccggcgccaacactgagcccgtaccgagccctttgtggatcttggtggacaacgcggtggttgtggacaaccccgccacccacacgagtgagactcagccgcccggcagctccaggtcgctcttgttcagctcctcaatgttcacgtccttgaacgtgagtacgcgcacctgcttcacgaagcgagcaggccggtacatgtcccacacccaggcgtccgccatggacacctcgaagaacacctcgccctggaccgagtgcacctgcatctcgtagtcgttggtgaggtagaagcgccgctcggtctcgatcacgtatttgaacagaccgacgacatcgcggtactcccggtagagcttcagctccatctcggtctcgtacttttcgaggtcctcggcgctcatggcatgttccccttcagccgtgcgtccccctattgtgcgccagccccgcgaacccctagacgatttcggtgtcgagggtctcgggcctggcggggggaccgtcgtcgagcagcctgctcagcagctcggcgacctggtcggatacaccgtctcatgtgcctcggtcagttcctggcacgtccaccaacgcgctccggcgacactgcgccgttccagttccgtcaggcccgcggccgccgtggccgtctgggtcgtacgggccaggtagtaccactcgtcctggtcccagcggcgcccggcgaacgggaacgagcacctgcgccgccacagcaccggacccagctcgacatcggtgatgccggtctcctcggcgagttcccgcagggcggcctcctcgcgcgattcgtcgccctccaggccgccaccgggcgtgaaccaccagttgtccgccggatcgtccggctcgtgcccgtgcagcagcaggatgcgctcctgcgggtcgagaaggaccacgcgggccaccttgcgcaggccgcccttgtacgagtcctcgaccccctcacccgcggcgcccgcgccggactcgtacgacgcgtagggcgcgtaggactcgtacgcgtcgtgcgacgaagcctcagcgggcaccggcgggctccatccgcgccccgctgcgcctgcggcgcgcccgattcgcgatcgggccgtacgccgcaccgcccaggaccagcaccgcccccccgacgatcgcggcgacgaccagccgcagcgggccgggagaggacaggcttcccagggcctcgaagcccgtagggcgctccagcatgccgttcatgggccacaccacggcgtccacccgggccttcaccccgctgcgcgccaccgtgccgtcgaaggcctcggtgaggtgggccgtggagtccagggagccgctgcgctcgtcgccgagcaggaacagccggtccttggggaccgtgaccgtggggatcgtccggacctccgcggcctggcccttgggcagatacggctcctggatctgcttgccgttgacggtcagcttgccgccggtgcagcagccgaccgtgtcgccgccgacagccacgacccgcttgaccatgagcatgtcgccccagctcttctgcttgaagacgacgacgtcaccacgcttgatgtcgcctccgtcgacccgctgggcaaggacccggtcgccggccacgatggtgggcgacatcgatggggtcggcaccgtgtacggccggtagacgaccgctccccaggcgaacccgccgaggaagagcacacagccgagggccacggccagtcccgacagcgtgctgccgagccgtccgtggccctcgtccgtacgaccggtcctgctcattcccgtgctccccaggtcggagaatcgatcccgcggcccggtgccgggccgcggaagatcggcgatctgggacggcaccctacccggcggtaccgtcgctagaaaccctcgggtttccgccggtaggaccgccggcgagacggtgcctgcgccacaggaccagcggcaccgctcccgcgagcccgagggcgccgggggctgccgcgctgaggttctggtcgaaggcgtccggaatcggcagcgtgttccagcgggtgggcggccaggcgatcacgatggcgcggccgatgacgttgtccacgggcacgaagccgtggttcttgtcctgctggtggtagcgggagtccagggagttctgccggtggtcacccatgacccagattttgcccttgggtaccttcaccttgaactgaccgccctggtcgtccacgctgcacggggtgttcccggcatagacgaaggtgtcgttcagcgcgtgaccgttgaccttcagggggccggtgcccttgcactcgacggtgtcgcccgcgacgccgatgacccgcttgatgaggtccttctcgttcgacgacggcatcaggccgatccagccgaggacccgctgcagggggttcggggtggccgtcggctcgcccgccagccagttggcggggtcgtggaagacgacgacctcgccgcgctcgggctccgagccgaaccagggggtcagcttgtcgacgaggacacggtcgccctgctggagggtgttctgcatcgagtccgagggaatcgagaacgcctgtaccaggaaggtcttgatcagcagcgccaggatcagcgcgataccgatgaggagcgggagttccttccagaaggagcgctgcttcttgggctgaccgccctgctcgccgctctcccgggtaccgccgccgtctccgtctccggagtcactcgcggaggtcgcggcgtcttccactgccgggggtaccgtcccgtcgtgccgctccggccgatcttcggggccatcgtgtccggatcgtgcgccgaccgccaaatcccccacatccactcctcactccgtgccgccgcccgcgccgtagtcggcgcaggcccaccactcccataacgagcgggagttccgcagggctcgggagggggatcaatccatatcgatccgcggaggccaccctatgcgacgggccgagagcggtggtcacgccgcccggcacggacgcgtacgtatccggttccttcaggcgcgtccagtggcccaggggccaggcgatgaccatggcgcggcccacgacggagtcctcggagacagtaccgccgtactgctcggtgcggtggtagcgggagtcggccgagttggcccggtggtcgcccatgacccacagacgcccctgcggcacggtcaccgagaagtcgaacgccgaaggtttgtttcccgggtgaatgtacggctcgctgagcggcatgccgttgacggtcacgcgcccttgggcgtcacagcacttgacggtgtcaccgccgacggcgacgacccgcttgatgaggtccttgtcgttgtcggagggcagcaggccgatggcgacgagaccctccttgacctgcttgacgacgacggggtcgttcttcttggtggtcttctcgcccgcgagccagttcccggggtccttgaagacgaccacgtcaccgcgctgcggcttggagccgaaccacggcgtgaacttgtcgacgaggacccggtcgccgatctggatcgtgttctccatggagcccgaggggatcacgaaggcctggaggaggaacgtcttcaggaccagggctatgaggacggcgacacccacgaggagaggtatctccttgaccgccgagcgccttctgcgccgcttgaccttgcgttgcagcttgcgccgctcggcgcgtcccggccgcacggcaccgccggaggcgcggcgcgctccggtgggcagcaggttctcggcggcgctgctcgacacaccgcggggtttgcctcggttacccatgggcaccgtccacggcgggcacgcgcgcgtaggcgccggggcgtcgaaggtgcgtcccgtggccggcgggccagacgatccagtcggcccggccgacgacttcaccgacggggatcatgccgccgcccggagagcccaggtggtcgcgggagtcgcgggagtcgctgcggtggtcgccgaggacgaagagcgtgccgtcgggaacgacgacgtcgaagtcgacatcggacgggctgtctcctggatacagaaacgacgactcgtcgaccggccggccgttcaccttgagcctcccctccctgtcgcagcagaccacatggtctccccctacaccgacaacgcgcttgacgtagtcggcgtccccgaaatagccggtgccgtcgaagacgacgacgtcaccgcgctgcggcttcgaaccgaaacggtacgccaacttatttacgagaacgcggtccccaatcctcaatgcgccctccatggaactgctggggatctggaacggctgcatcacgaagttgctgagcgccaggagaaacagcaggcagctcagcagggtgagggtgatccgcccgcccgggagccagtcggcgacccgggacaccaacgcgaaacgcgaccggccctccggcccctgtgtgtccgagatctcctcggattcgaaagggctggaggagcggtcgcgctccgtgtgctgtgcttcggtgtccatcggggccagatgctatccggcccccatgtgaacctccgcgcgagatcagctctcgcgcttctccttgatcttcgcggccttgccgcgcagctcacgcaggtagtagagcttggcgcgacgcacgtcaccgcgggtgacgagctcgatcttctcgacgatcggggtgtgcaccgggaaggtgcgctcgacgccgacggagaacgagaccttgcggaccgtgaaggtctcgcggacaccggcaccctggcgacggatgactacgcccttgaactgctgcacacgggagcggttgccctcgatgacgcgcacgtggacgttgacggtgtcacccgggcggaaggccgggaggtcgctgcgcagcgacgcggagtcgacggagtcgagcaggtgagacatttcgtctgctttcttcgctgatgccacaggtcatcaacgggagatagatgttccagaagaggtgctgcccgtatcggggcgggcgtcgtgtccccccgtggcaggggcgcgcgccggacgacgtacagcagcggcctattcttccatggcctctggcctgcgccaaaatcggccgtgcggcactccgtcgggatccgggaaccagcccaggatcgagagcatttcgcggtccttcttgtcgaacgccgaggggtcgcagcgctcgatgaggtcgggccggttggcggtcgtgcgcttcagggcctcgtcgcggcgccagcgggcgatcctgccgtggtggccgctgagcagcacctcggggatctcccggtcgcgccacgccgggggcttggtgtagacgggcccctccaggaggttggccatggcgccgggtgcgaaggagtcgtcccggtgcgactcggcgttgccgaggacgccgggcagcagccgggcgacagcctccgtgatcacgagtacggccgcctcgccgccggcgagcacgtagtcgccgatggagacctcgtagacgggcatccgggtcgcgtactcgtcgatgacgcggcggtcgatgccctcgtagcgcgcgggggtgaagaccagccaggggcgctcggagagctcgacggcgagttcctgggtgaaggggcggccgctgggcgtcgggacgatcagagcggggccgtgggcgtccgtctcgtagccgtcggcgagcacggagtccagggcgtcgccccagggctccgtcttcatgaccatgcccgggccgccgccgtacggagtgtcgtcgaccgtgttgtggcggtcgtacgtccactcccgaagatcatgcacgtgcacgttcagctgtccacgcgcgcgtgccttgccgacaagggagacgttcaggggttcgaggtactcgggaaagatcgtgaccacatcgacccgaagggtgccgtgccgcatcaggcgtctgcctccgtggcggcctcggtatcggaggaatccacttcggcccggtcgtcgatcaggcccggcggcgggtcgatgaccgcccgctgctcctccaggtcgatctcgaccacgatctcctcgacgaacgggatgtacacctcgctgccgtcggaccgctccaccacgaagaggtcctgcgagggcaggtgcgagatctcggtgatgcgcccgacctccgtcccgtccttcgtgacgacgtccaggtccatcagctggtggtcgtagtactcgtcggggtcctccggcacctcgtccgggtcgacctcggcgatcagcagggtgttgcgcagcgcctcggcgccgttgcggtcacgtacgccctcgaaacgcagcaggaggcggccgctgtgcacgcggccggtctcgatggtcagcggtccgacggaggccgggtccgtggccagaacggctccgggccccagcctgagctcgggctcgtcggtacgtacttcgacggtgacctcgcccttgatgccgtgggcacggccgatccgtgcgactaccagctgcactgtgcttgctctcctgtcgaacgactgcgagccgaaggcggctcgtacgactacgggccggggacggcccagtggccctccccggcccgagccggtgctgcgtttacatcagcggacgtgatccacgtcgacgaggtcgacccggacgccgcgaccgccgatggcgcccacgacggtgcgcagggcacgcgcggtgcggccgttgcggccgatcaccttgccgaggtcgtcggggtggacccggacctcgaggacgcgcccacgacgcaggtcgcgcgaggcgacctgcacatcgtcagggttgtcgacgatgcccttcacgaggtgctcgagagcctcctcgagcatgctcaggcctcggtcgactcagacgaagaggactcagcggcagcttcgtccttcttctcagccttcttcttctgggtgatggcctcacccttgcccgcgtcgtcgccaccaagggcgtcgaacgacgggcgcgtggccttcggcgcggccacgagcagcggagccggggcgggctcgcccttgaacttctgccagtcgccggtcttcttcaggatcgcgaggacgggctcggtcggctgtgcgccgacacccagccagtaggcgacgcgctcggcgtcgacctccatgcgggaggggttctgcaccgggtggtacagaccgatctcctcgatggcccggccatcacggcgggtacgggagtcggcgacgacgatgcggtagtgaggcgaacggatcttgcccagacgcttcagcttgatcttgactgccacggaagtggtgtctcctggtcttgacgtggttgggcacggcgagatggccgcgtggggttgcggtacccgagtgcccgatggacgcgtcagccggaggagagaggggtcctatgcggctgtcgagtacagctagccattgtgccacaccctgcgggtcgctccagccgggtggggacgccgggcatgcgtcatcgacgcccggctcctgatgccgggcgtcgcctgcgcaccccgggggcccacacgtgccgctgggtacggctgccacgagcagccgtctcctcagcttgccgccgcgcccaccacctcggggatccggaacggcttgccgcaccccccgcacacgatcggcgcctgcgcgaggaccgacgggacgacgcgcacattgcggccgcagtcgcagaccgccttgacgcggacgcctcctccggaggagccgtgccgggcggccgggccgcggaagctgcgggccgtgtcggcggcggtcgcggccgtgtgggccttgagggcgcgctgcagccgctcgatggtcgggcggtagcgccgcttcgcctcggggttgagcgtgaccagggagaagccactgctgggatgcggctcctccgggtggtccaggcccagctcctcggcgatcgcgagaaatctgcggttgtggtatcggccggcgcgcgaggtgtctcggactccacgcgcggcggcgatgccgtggactgcttcatgaagcagtcgctcgaaagagagttcgtgtccgcaggcggacgacgactctccgatcagggactccggcgcggcaagatcgggcagctcggggtggtaccgctgaatgtcggcccacgcctgtgccagctctgcggcgagaacaggtggtgtcgtgctcacgtcgtgacaacgagccggagtgcccctgtgttcctattccgggccatcccaaataatttgcacgtacccgtcagttgccgctgatgcgtcctgacgagggcgggtgcgctgatctgcggagaagccgcacagctcgtaccaaggtggtgcgtagtcgcacgtacgccccggcgcgtagaccaggtccgcgcgccggggtacctgcggtcatcagatgcgcaaggggcgtttcggccgctctcgccgacggagcgacgtacctcagtaagcgcgcgcgacgacggcgacgttaccgggtgcgtcgtcggcgcccggcaccgacccgtcctcggcgaccagacaccgtacggacgcagcgtgctcggccagctcggcctcgcccctctcgccgagggtcgcccacggaatgcgcgcccagccgccgccggcggccgcctcgacggcctcctcgatcgtcgacacgtccgacgtacgggatgcgcggcgctcgcgcgcctgcctcagaaggagcgcctggtcctcctcgagggccgtgggcagcagcgcggccagcgcgtccagcgccaccggctccttgccgccggggatacggcgcgccaccatcgcggtgccgttctccaggtcacgggggccgacctcgacgcgtacgggcacgcccttcagctcccagtcgacggcgcggcgcccgaaggggacgtcggtgcggtcgtccacctggacgcgcaggcccgccgccttcagccggtcgccggtctcgcggaccttggccagaaccgcttcgtcgcccttgatcgcgaggacgacgacctgggtctgggccaggcgaggcggcacccgcaggccgttgtcatcgccgtgcatcatcaccagtgcgccgatcatgcgcgtggtggacccccaggaggtctgccagacgagttcctgcttgccctccttcgacaggtactgggtgtggaacgccctggcgaagttctggcccagctcgtggctggtgcccatctggagggccttgccgtcgcccatcatgccttcgagcgtgagggtgttgacggcaccggcgaagcgctccttggcggtcttgcggccgaggacgacgtccatcgcaaggacgttctccatgaagtccgcgtagacgtgccggtggatgtgggccgcgaagtcgcgcgcctcctcgtacgtggcgtgcgccgtgtgcccctcctgccacaggaactcggtcgtccgcaggaacagacgggggcgcagctcccaacgcaccacgttcgcccactggttgatcagcagcggcaggtcgcggtagctctgtacccacttcgagaagtagtcgttgatgatcatctcggaggtgggacggacgaccgcgggctcctccagctccttgccgccgccgtgcgtgaccacggcgagctcgggcgcgaagccctccacatggtcggcctccttggtgaggtacgactgcggaatcagcagcgggaagtacgcgttctgggtgcccgtctccttgatgcgggcgtccatctcctgctgcatccgctcccacagcccgtacccgtacggtcggatgaccatggtgccgcgcaccggcccgttgtccgccagttcggccttgttgatcagatcctggtaccagcgcgggaagtcgtccgcccggggcgtgagaacgggtgcctttgccatggcgcgatggtacgggcaggccctcccgcgccgggcatcaattgtcacccgcacgtgcccctccggcgcgtgccctgggcgcgcgcagacggcgcacaaggagtgggccgcaacccctggacgccacgacgggcgcggagtttcctggcatacggggggagtgcgagcgcactgcacgggggccatggaatcggggcacaggggcaactctcggcggattggggcgctttcgatgacacctacgctcgtgcggcagcacctacctcacgcggggcccgcgccccgtgtggacccgtgtgcacgcgcgcgtgactgggccgagatccaggagcggatgctggtgccgctctacgaggccgtccacgagcggctcgaggtgggccccggcacccggctgctcgggctcggctgcggttccggtctggccctgctgacggcggcgtcccggggtgccgcggtcaccggtgtcgacacgcgggtgcccgagcggctggccctcgcgcgcgaacggctgctgcccgagtcgcggggcacacgcgcgcgtacggacccgcgcatcgtcgacggcacccccgaggacgcggccgccgctcccggggaacccgggtacaacctggtgaccgccttcgagccgatcggctgcgcgaccggggacgccgaaaggctcggcgaactcctcgccgccgcgacaccgctcgccgggcgcgggacgcccgtggtgctcgccggatgggggccgccggaacggtgcgccacctcctcggtgctgcgcgtcgccacccggctggccgatccgctgcgcggtgcgcgcagttggcgccccgcgctccgcgacgacctcgaggagatcgcccagcgggccggcctcaggccggacgggtcgggacgggtggcgtgccccttcgggtacgccgatgtgaacaacgcggtacgggggctgctgtccacggggctgttcgacccggcgatcacggcgaccggccaggagcaggtggacaaggaagtgacggaggcactgcatccgcatgtgcggcaggacgggaccgtgtggatgccgaacgtcttccgctatctgatcgcccgcacgccccagtgatcagatacccccgtacccgcgggaacgcgctggggcgcccctccggagaggggcgccccagcgccgtacaccacctgctcgggcgtcagcccatgaacttcttgaactcgtccggcagctcgaagtcctggccgccctgctggggcaggccgaacgcgttgccgccctggtccgcggcctccttgcgggcggcctcctccagctcctgctgcctgcgcttcatcgggttgcccgagcgctgcttgcccttggcctgcttctgcttcttcttctgccggccggggccgccacccatgcccggcatcccgggcatacccggcataccgccgccctgggccatgcgggacatcatcttgcgggcctcgaagaaccgctcgaccaggcccttgaccgcgctgacgtcgacgccggaacccttggcgatacgggcgcggcgcgagccgttgatgatcgtcggctcctggcgctcggccggggtcatcgacttgatgatcgcggccgtgcggtcgacgtcgcgctcgtcgaggttgttgatctggtccttgatctggcccatgccgggcagcatgccgagcagcttgctgatgctgcccatcttccggacctgctccatctgggacaggaagtcgtcgagcgtgaagtcctggcccttcttggacgccagcttcgaggccatcttctcggcctcttcttggctgaacgtcttctccgcctgctcgatcagggtgagcaggtcacccatgtcgaggatgcgggaggccatccggtccgggtggaaggcgtcgaagtcgtcgagcttctcgccgttcgacgcgaacatgatcggcttgccggtgaccgaggcgatcgacagggcggcgccaccgcgggcgtcgccgtcgagcttcgacaggaccacgccgtcgaaaccgacaccgtcacggaaggcctccgcggtgttgaccgcgtcctgaccgatcatcgcgtcgacgacgaagaggatctcgtccggcgagaccgcgtcacggatgtccgcggcctgctgcatcagttcctggtcgatgccgaggcggcccgcggtgtccacgatcacgatgtcgtggaccttggtcttcgcgaactcgatggagtccttggcgaccttgaccgggtcacccacgccgttgcccggctcgggcgcgtagaccgcgacgccggcgcgctcggcgacgacgctgagctggttgaccgcgttcgggcgctggaggtcggcggcgacgaggatcggggagtggccctggtccttgaggtgcttgccgagctttccggcgagcgtggtcttaccggcaccctgcagacccgcgagcatgatcacggtgggcgggttcttggcgaacctgaggcgtcgcgtctcgccgccgaggatcgtgacgagttcctcgttcacgatcttcaggacctgctgggccgggttcagcgccttggagacctcggagccgagggcgcgctccttgacgttcttgatgaaggtccggacgaccggcagggccacgtccgcctcgaggagcgcgatacggatctcgcgggccgtggcgtcgatgtccgcctcggacaaccgtcccttgccccgcaggttcttgaaagtggctgagaggcgatcggagagagtatcgaacacggcgctcgtcggtcctcggagtcgggggcagtctgggtcgccctccagggtatctggccgcgtgcggtcgggtctccaccgcgtgcgtacgaaaccggggacgccgtacacggcggagggcgcccccggtccggccggcgctaagtgcgcaatgtctcctccagcgcccgcgccaccgtcgccgcctcctcgcccggcaggggcccgcccctcgtaccggtgacatagaaggcgtccacggcgttcgcgcccagcgtcgacacgtgcatgctgcgcacccgtacgcccgacttctccagcgcccgcccgatgcggtgcagcaggccgggggcgtcgtgggcgcggacctcgatgaccgtggccaggtgggaggccgccgaggcgacggtcacatgcggcgggggcgccacgacaccgcggcgtcgcggataggcggcgtcccgctcggcgagacgggccgcgatgtccagggagccgtcgagggcgcggacgaggtcggcacgcagccgggcggcctgcggcagggagccgtactccgccgccacccgccagttcagcagcagtacggagccctcgaccccgtccggcagcggcagcgcccgcagttccgccgtacggaccgtgagccggtgcatcgcgagcaccccggcgaccgccggcagtacgcccgactggtccggcaccgcgatgagcagctccacgcccaggggctccgggtcgtccgggaccgcgttgtcggcctcggtggcccccggttcggtctgggcacgcagcgccagcaccgggccgccggtgcggaaggcctcgacggcgagacgttcctgctcggcggtgggcgcggcggcctccggctcctcgggggcgtcgcccgcgagcacggccgagacccgcttcaccaggtcggccaccagggaaccccgccacgacgaccaggcggcgggcccggtggccagcgcgtcggactcggtcagcgcgtgcagcagctcgagggtgctctgggaaccgaccacctcggcgaccgcgcgcacggtcgccgggtcctccaggtcacgccgggtcgccgtctcgacgagcagcagatggtggcgtacgagggtggcgaggacggcgatgtcctcgcggtcgaagccgatccgggccgccacgtcccgcgcgatgatctcgccggcgacggagtggtcgccgggccagcccttgccgatgtcgtgcagcagggcggacaccaggaggaggtcggggcggccgacgcggcgggccagttcggaggcgcggacggccgtctcgatgaggtgccggtcgacggtccagatgtgcacggcgttgcgctgggggcgacagcggacccgttcccagtcgggcagcaggcgggtgatcaggccctccgcctccagcgcctcccagacctcgatggtcgaggggccggagccgagcagcgtcaccagctgctcgcgggcctccgcgggccacggggtgggcagggggcgcgcggcggcggccatgcgccggaccgcgtgcagggagagcggcagcccggactgggcggccgccgcggcggcgcgcagcggcagtaccgggtcgcggtcggggcgtgcggtgcgggcgaggacgacctcgccgtcctgctcgacgacgccctccgcgagcggtgagcgctcggcgaccggctttccgccgccgagcatggcgcgcagacgcggccgtacggcgcgcgaccgcagtacgcgccccacttcgcgccaggtcacatcgctcgcgtacgagacgacgcgggcggcctcgtacacctggcgaaggagggtgtcggcgtcgagcaggccgagttcggcggcgacctggtcctgctcctgcaacgcgagcctgtcggtggcgcggccggtggtgaggtggagggcgtcacgtacgtcgaggagccggcggcgggcgtccgtgaggccctcgcgcggggcgtccgccagccaggacgcggcgaccgcacgcagcgcggtggcgtccctgaggccgcccctggcctccttgaggtcgggctccagcaggtactgcaactcgccctgccgctcggcccgttcggcgcacagctcctggagttccgggagacgtttcggtgcctggttgcgccagtccgcgaggacggcggtgcgcagcccggcggtcagggcgaggtcgcccgcgaggtgccgggcgtcgaggaggccgagttgcaccttgaggtcctcacccgcggtcttgcgtgcttcggcgggcgtacggacggagtggtcgagggcgagaccgaggtcccagaccgggtaccagatgcggtcggcgagggcggcgaccgcgccctggtcaccgccgtcgtggagcaggagcaggtcgaggtcgctgcgtggggacagttcgccgcggccgtagccgccgaccgcgaccagtgacacgccccgcggtcccgcgccgcccgcgtcgaacaggccggtcagccagtcgtcggtcagttcggcgagggcagcacggcgcggcggcccggaccgcgccccctctggaggaggcgcagccgggccgccgcgtagccgctgggtcccgagtcctctgcatccgtacgtacgtccgtactcgtcacccagcgactcctgttctgtcggtgccttacagcgcgtcgggtccgcgctcgccggtccggacccggacggccgtgtccaccgggatggaccagaccttgccgtcaccgatcttgccggtgcgggccgccttcacgacgacgtcgatcagctgttcggcgtcgtcgtcctcggccagcacctcgatacggatcttggggaccaggtcgaccgtgtactcggcgccgcggtagacctcggtgtgtccccgctgacgaccgtaaccgctggcctcggtgaccgtcagaccgtgtactccgaaggcctggagggcttccttgatctcgtcgagccgatggggcttcacgacggcggtgatgagcttcatgcgtccaccttcttggtcgccgtgtccgcgagaggggcggggaggatccgggccgcgccgccgcccgctccgctgaagtcgtatgcggtctcggcgtgctccgcctggtcgatgccggcgatctcctcgtcctcggaaacccgcatcccgatcgtcttgtcgatcaggaaggcgaggatcgcggagacgaccagggagtaggcgaggaccgcgaagactccggcgcactgcttccacagctggtcgaaggagtggtcgccgtagaagacgcccgtcgcgtcggactggccgccgccgctggcgaagaagccgatgagcagggagcccgcgacaccgccgacgaggtggacgccgacgacgtcgagggagtcgtcgtagccgaacttgtacttcaggcccacggccatggcgcacaggacaccggcgatggcgccgacggcgatcgcgccgagcggggagaccgcgccaccggacggggtgatggcgaccaggcccgcgaccgcgccggaggcggcaccgagggtggtgaacgcgccgtggcggatcttctcgtacgcgagccaggcgagcatcgcagcggcggtggcgatctgcgtgttgatgaacatcagcgcgccgacaccgtcgtcgttgccgagccacgagcctgcgttgaatccgaaccagccgaaccacagcaggccgcagccgagcatgaccagcggcaggctgtgcgggcgcatcgggtccttcttgaagccgacgcgtttgccgatgaccaggatgacgccgagcgccgcggcacccgcgttgatgtggaccgccgtaccaccggcgaagtcgatcacgccgaggtcgaaggcccagccaccggtgccccacacccagtgcgcgaccgggaagtacacgaccgtggcccacagggcgacgaacagggaccaggcggtgaacttgacgcggtcggccagggctccgcttatcagggcgggcgtgatgatcgcgaacatcagctggaaggtggcgaagacatagaccggaatggtgtaaccgggccagagctccaccttgccgatcccggtgaagccgacgaagtcggacgtccagccgatgagcgaacccttgtcggtaccgaaggcgagcgagaagccgtacagcacccacaggatggtgacgatgcccatgctgatgaagctcatcatgagcatgttcagagtgctcttgacgcggaccatgcctccgtagaagaaggccaggcccggggtcatgatcagtaccaaggcggaacagatgagcatgaagcctgtgttggcggcagacagcttgggagcctctgcggcaagcgtgatggctggtgccatcggcgtctcctcgtcgttggtacggccccgtgcgggcgaaacctgagcggtcaagaggggtgggccggttatgcgccatgagattggcgcagcgcggtttcggtcggcgcccctcgatgtttcgccgcagtgacgaaggcgctgtgcgtgttacgcgtccatgaactgcctgctaagggcccgcgcgatcgttatcgtggcgcaaccttccgagaaggcagaaaaccggccgcggctgccatccgatgacctggcatgggggagccgagtcgggcggttcgggatggcggccgcggccggggaccaaggggcccttgggtggccggcgggaccgggggtcataccgcttcggcggtctcgggcaggtggacggcgagctgggcggtcaggtcgccgacctcggcgagatcgccgaaatcgcgtacggccgtgtcgacggtctttcggatacgagtgttcacgcgctcggagcgcacttttttggcgacttccatcgcctccttggccagaacggcactccgctcgggctctcgctggagcaggtgcacggtggccatgccgatgaggttcagtgcgtacgaacgctggtgctcgctgtccttggcgaacaggtcgacggccttctgcatcacgggctcggccagggaggcgtaggtggggctgcggcccgcgacataggcgaggtcgcggtaggagtgggagttctcgccgtgcagctcggcctcggagaagaagcggatccagtcgggctcgggctcgtcggactcgagcgcgtcggcgaacgtgtcctcggccatgcggacggctcgcttgcacttgccgggctgacccatgttggcgtacgcgcgggcctccatcgcatacagcatggactgggtgcgcgggctcgcgcagtcacggctgccgtactgggcgagatggatgagttccagggcgtcctcggggcggccgaggtggatcatctggcggctcatgctggagagcacgtacgagccgaggggcttgtcgccggcctccttggccgcgtgcagggcgaggaccaaatacttctgcgcggtgggctggagtcccacgtcgtagctcatccagcccgccagctcggccagctcggcggcgaccttgaacaggcgtttggtggtggccgcgggctggggctcctggaggaggtcggtcacctcgtgcagctggccgacgaccgctttgcggcgcaggccgccgccgcactgggcgtcccactgccggaacatcacggtggtggattcgaggaggtccagctcgggcctggacagccggccggcgcggcgcgacgcggccaggggctcgggctcctcccgcggggcggcggggccgggcacgagccagcgctgcatgggttcgatgagggacgggccggcggcgagggccagcgacgtaccgaggaagccgcgccgcgccagcatcaggtcgctgcgcgagaactcgctgatcagcgccacggtctgcgggcccgtccagggcaggtcgacgccggacacagacggtgcctggtgggcggtgcgcagtccgaggtcctcgacggcgaccacacagccgaagcgctcggagaacagctcggacaggatgcgcggaatcggctcacgcgggttctcgccgtcgagccagcgccggacccgcgaggtgtccgtggagatgtggctggcccccagctggcgggcccggcggttcacctgtcgtgcgagctcgcccttcgaccagccgctgcgcacgaaccacgagcccagaagctcattggggcgcctgtcagcgttcgtaccgcttccgccgttgccgcccactggaacgcccccatccctgaaaccacttgtgcgctgtgtgcgccaagccctaccagaatgccggtaaacgcggccgtctgtccggcggttctcacccgtcgaacggtaagccgacttgcctccggcatacccatgagcgcatgcatccccagggctcgtgcactcaacgtaatcccacgatcacgggtccagccatggcgatcccggaaacgccaccattcgccaccccttcggatgaactcccggcgactcgtacgcgattcacttgacagtggacggccggaagtgggtgaagcggtgcacaaagaggcgtgcgccaccgagcgcactacccggagcaccacagggcgccgcccggagcatgcggcgaccgaggaggtcggtaacgccgcgtcacgatccgcttccgtctcgtaaccaccggcgcgctggacccgttggagggggtatgggcttcacgatcggcggtacgcgcggaatccgcgaaattcgacccggcgcccggcgccgtggccgctcgtcggagtgcaccgccgtggccgagtacaccggactgtggggctgggacgtcgtcgccggcgcccgggccgcggcgggcgcgtgctcctgcggcagggcggagtgcgtccggcccggcgcacatccgctggacttcgccactcccctgcccgccggcgcgacgctcgacgaggtgaccgaggcctgggccgaggtccccggcgccgccgtgctgctgccggtcggccgcgcgttcgacgtgatcgaggtcgccgaggccgccggacggcacgccctggtccggctggagcgcatggggctcccgctcggcccggtgaccgcgactccggacggccgcgcccacttcttcgtcgccccgggcgcggcggccgaactccccgagttgctctaccggatggcctgggacgacacctccctcgacctgcgcgccctgggccccggtacgtacatcacggccccgccctccgacctcggcggtctcgggccggtgcgctggctgcgctcccccgcgctcgactcggcgacgaacccgcccgccgcgcggctgctcctggggacgctggcctacgtggcgcatcgatcgcgcgcgtagcgccacgcgcgcgcagacgaagcgcccgtccccaaccgcaactcgggggcgggcgcttcttcgaccacttaccaggtttcgtaagtgggtcactctccgacaagagcgtcaacaaacgcctccggctcgaacggcgccaggtcgtccgcgccctcgccgagcccgatcagtttgaccggcacccccagctcgcgctgcacggcgatgacgatgccgcccttggcggtgccgtccagcttggtgagcacgatgccggtgatattgacgacctcggcgaagacacgtgcctggaccaggccgttctgcccggtggtggcgtcgaggacgagcagtacctcgtcgagcggggcgtgcttctcgacgacgcgcttgaccttgcccagctcgtccatgagcccggtcttggtgtgcagccgccccgcggtgtcgatgaggacgacgtcggcgccctcctcgatgccctccttgacggcgtcgaaggcgatcgacgccgggtcgccgccctcgggtccgcgcacggtgcgggcgccgacgcgctcaccccaggtctgcagctggtcggcggcggcggcacggaaggtgtcggcggcgccgagcaccacatgcttgccgtcggcgacgagcacccgggcgagcttgccggtggtggtggtcttgccggtgccgttgacaccgacgaccatcacgatcccgggggtgtcgaggttggagtcggtcctgacctcgcggtcgaactcggggacgaggagctggagcagctcttcgcgcagcaggccgcgcagctcctggggcgtacgggtgccgagcaccttcacccgctcgcgcagccgctcgaccagctcctgggtgggctgcacgccgacgtcggcggtgagcagcgtgtcctcgatctcctcccaggtgtcctcgtcgaggtgctcgcgcgacaggagcgtgagcagccccttgccgagcgcgttctgcgagcgggagagccgggtgcgcagccgcaccaggcgtcccgcggtcggctccgggacctcgatcgccgggacttcgacgacgggtgcctcttcgacggcgaccggcgccgccgccgacttgtccgggagatcaacctcctcgatcgttctgcgcggttcgtcgcgcggctgctcggcctcgtcgccgacatgcggctcggccggaggggcggtgatgtcgggcgtcgtggggggcgccgggggcagcggcttcttgcggcgactgccgatgacgagcccaccgagcgcgccgagcacgaccacggcgatgactacagcaaggatgacggtttccataacgcgtccagtatcggccatgggcctcgaaccggccgagcttgcgcgttccgccgagggacataggccgttttagtgatgtactcggattaacgtacgatgtcgccccatgagcaccaccgcatcgaacgatggcgccctcgaaacgcacggcgagtcccacggcctcgaaacccgaggcctagaccccgtcccccactccgagcgcaccgcccgcacccgggaactcctccccacctgggtcgccgccaatatcagcgttctgctcctcagcatgggggcggggctggccgtctcgtacggactgaacttctggcaggccctcgtggtcggcgtcgcggcgccggtcgtgtcgtacgggctggtcggcctcatgggtatcgccggcaagcgcggtggcgcgcccggcatggccctgtcccgcgcggtcttcggccagcgcggcaacctgctccccggcgcgctgatctggatcgcccgctggggctgggagacgatcaacgcggtgaccggcgcctatgcgctgctcaccgtcctgaacatcctcttcggcatcaggagcaacacgttcctgatcatcgtgacactgctgctcttcgtcgtcaccaccttcgtgatctccggcctcgggatcaacgcggtgcgcaggtgcaaccggtgggcgtcctacctcttcgccggcttctccgtgctcgtactcggccatctggtcgtcgacaccgactggggcaaggtcttcgggcaggcggcgggccccacgcccctgatgatcaccggtgtcggcgtgatcgccgcgggcggcatcagctgggctccctcctcccccgacttcacgcgctatctgccgcgtacggcgtcgtctgtggcgatcgtgcgcaacacggtcggcggcgccggcgtcgtcgtcctgcccatggtcctgatgggtgcggtcatggcggtctccacgcccgatctggcctcggcggccgacccggtgtccttcctcggcgagatcctgccgttgtggatcgcggtgccgtacctgctcatcgccctggtcggcatgctgctgatcaacgccatgtcgatgtactcggcgggcttcaccgcgcagaccctcggcttccgggtgccgcggcactgggcggtctccgtcaacgcggtgatctcgctggtcttcggcggtgtcctgatgctggtggcgacctccttcatggggtccttcatcgccttcctgtcgctgctcgcggtcgcgttctcggcctgggtcggcgtgttcggcgcggacatgctgcggcgccgtgagtacgacgccggggccctgctcgacaccacgcgcaccagcgcctactggtaccggggcggcttcagcccggccgcggtcgccgcgtgggcggtcggcctgggcaccgggctgctgttcacgacgtccgactggttcaccggcccgctggcgagcggcaacccggtcggcgagtacgggctcggctgggtggccacggtcgtggtgtccttcctgctgtacgtcgccctgcccaagcccgcgctcccgcggacgccggctcccgccacggaagagcccgcacccctggctgtctgacgcaccgtcagctaccgtccccctccacacacgaaggggggctcccatgcccgtgacggtcgtacgtttcaacctcgtcgagcccggcgcgacgcccgcctcgctcagcgcccgctaccgggcggcgctcgagatggccgcgtacgccgacgaccgcgggatcaccaccgtgcagaccgaggagcaccacggcgtcgccaacaactggctgccctcgccgttcgccttcgcgggcgcggtcttcggtgcgacccggcacatcgcggtcaccgtctcggcggtcatcggccccctgcacgacccgctgcgactggccgaggacatctccgtgctcgacctgctcagcggcggccggctcatcacggtggcggggatcggctaccggcccgaggagtacgccctcttcgacgtcgactggaagaggcgcggcaggctccaggacgagcttctggagaccgtgctgaaggcgtggaccggtgaggagttcgagtaccggggccgtacggtacgggtcaccccgcgcccgttctcggatccgcacccgctcctgctggtcggcggctcctcgaaggccgcggcccgccgtgccgcccgcctcggcctccccttcttccccagcgcgcatctgccggagctggaggcgtactacaaggaccggctcatcgagtacggcaccgagggctggaccatgatgccgtcggccgtgaccccgctgctgcacatcgccgaggacccggaccggacgtgggccgagtacggcgagtacttcctgcacgaggcacggacgtacgcctcctggcagtccgcggagattcgctcggcggtgaagtcggccgccaccacggtcgacgagctgcgcgccgagggtgtctaccggatcctcacgcccgacgagtgcgtggcccagggcctggacaaccatgtcctgcatccgctgtccggcgggatgcccgtcgacgagggctggcgcagcctgcacctgttctgcgaaaacgtactgccccggctcaaggacctcgagggctgagccggggcggtacgtctcttacgagtacgaggagaggggcagcggggacttggcccttctccccgagcttcggggagggaggggggtcagcccatctcctccagcgccttgcccttggtctccttcacgaacttgagcacgaaggggatggagagcgcggcgaacaccgtgtagatgatgtacgtgccggagaggctccagtcggccagggacgggaagctcgcggtgatcgcccagttggcgatccactgggccgacgcggccacaccgagcgcggcggcacggatcctgttcgggaacatctcgccgaggaagacccagaccacgacgccccaggagagggcgaagaagaggacgaacacgtgggcggcgatcagggccacccagccctgggtggccggcagcttgccgtcgacgaggtcgtacgagaaggcccaggcctccagcgcgagaccgatgaccatacccacggagccgatgatcgcgagcggcttgcggccgaccctgtcgacgaagatcatggcgatcacggtgccgatgatgttgatgatcgacgtggtgaacgagtagaggaacgagtccgtcgggtcgacgccgaccgactgccacagcgtcgccgagtagtagaacgccacgttgatgccgacgaactgctggaagaccgagagtccgataccgacccagacgatcggcttgaagaagaaggtgccgccgagcaggtccttgaagctcggcttctcctcgcggtacatggcgagcctgatctcctccacgcgggcgtcgaggtcgatctccttgccctcgacctcttcgagcacctcacgggcgcgcgcgtccttgcccgcttcgatcagatagcgcggcgactcggggatcgcgaaggagagcagaccgtagaggacggccgggacgaccatgacgccgagcatgacctgccaggcttcgaggcccagcagcttgccgcgctggtcgccgccggcggcgttcaggatggcccagttgaccagctgcgagatggcgatgccgatgacgatcgcggcctgctggaaggagccgagacggccgcggtacgcggccggggcgacctcggcgatgtaggcggggccgatcacggaggccataccgatggcgaagccgccgatgacgcgccagaacgcgaggtcccacagcgcgaagggcagcgccgagccgatggcgctggcggtgaacagcacggcggcgatctgcatgcaccggatgcggccgatgcggtcggctatgcggcccgcggtcgcggcgccgacggcgcagccgatcagcgcgatggcgatgacctgggccagggtcgcggaaccgatgtcgtacttgctccggatggcctcgacggcgccgttgatcacggcactgtcgtaaccgaagaggaagccgcccatcgcggccgccgccgcgatgaagatgacatggccgagatgctcgggatgagcttcccgggctccgggcgcctgcgctgtgctggtcacgtaaaactcctcgggccaccggcctcgctgccgggggtgggggcgagcccttcagtcatggttccagtggcgcacaacttcacgccgcccaccacctgaaggtaaaagcaacgttgcagagactatgccttcaagtaacgaagtcaatagggggtccgctgtgagttttaacgactcagagttgcacttaccttcaagacttgaactcaacccatggacaggatccgcctaccccgaggaccggaagacaagccgcggcgtgtcagcgcagccgctggctgatgaccttcgacaccccgtcaccctgcatggagacgccgtagagcgcgtcggcgacctccatcgtgcgcttctggtgcgtgatcacgatcagctgcgaggcctcctggagctcctgcatgatccggatcagccgctgcaggttggtgtcgtcgagcgccgcctcgacctcgtccatcacatagaacgggctgggccgcgccttgaagatcgacacaaggagggcgacggcggtgagagacctctccccgccggagagcagactcagccgcttgaccttcttgcccgggggccgcgcctcgacgtccacgcccgtggtgagcatgttgtcgggatcggtcaggatcagccgcccctcaccgcccgggaacaaccggccgaagactccttcgaactcccgtgcggtgtcccggtacgcctcggtgaagacctgttcgacgcgctcgtcgacctctttcaccacctgaagcaggtcggcacgggtcttcttgaggtcctccagctgctcgctgaggaactggtggcgctcctccagcgcggcgaactcctccagcgcgagcgggttgacctttcccagctgctggtacgcccgttcggctgacttgagccgcttctcctgctccgcccgcgcgaacggccggggccggttgcgcgggtgctccgggtcgtcggggagttcctcgccctcggccgcgggcgagggcggcacgagctgatcggggccgtagtccgccacgagccccgccggttccacaccgagttcctccagcgccttcgactccagctgctcgatgcgcagccgcttctcggcgccgagaacctcgccacggtgaacggaatccgtgagcttgtccagctccgccttcaggtcgcggccggtgccgcgggcggcggcgagttcctgctcccggcgcgccttggcggcctcggcggcggtgcgctccttgtcggcccggccgagggagacctcgacgtgcgtgagcagctggcgcgcaccggaggcgacggcctcggcgacggccgcctcgtgtctgagccgcgcccgccgctgctcggcacgcgcgcgtgcctcgcgttcggcgcgggcggcccggtcgagcgagtcggcccgcccggcgagccccttgacccgttcctcgtgcgtacgcacctggaggcgggcctccatctcggtctgccgcgcgttggccccgtcggcggcgagccggtcgcgtacggaggtgtccggctcctcctcgacgggcatctcctcggccacggcgagccgttcggccagttcctcggcctcctgtacggcgcggtcgagcgcctcctgcgcccgcgcgacggcggcggcggtgcgttcggcctcgcctgccgcgccccgcgcctgcccggccagccgcccgagctgctgggcgacggcggacttctcccgctcggcggagcgccgccgctcccccaactcctctaccagcgccgcccgttccgtgcgccgctcggcggccaggcgctgcgccccggtcagctcctcgcaccgcacggcgagctcttccagctcggccgcggcctcgtcgacggacgcctgcacctcgagcagactcggcgccccggcggacccgccgtgcgcgaagtgcgcaccgagcaggtcgccttcggcggtgacggcggtcagcccgggccgcgcgtacacgaggtcctcggcgtcctcgagggtgccgacgacgacgatgccgcgcaacagacgccgtacggcgggcatcagttcggcggggccacggacgagatcggccgcgtacggcggaccgccgcggtgctccgcagggggtacgtcggtgtgcgcggcacccggccgccgggcgtgttccggttccggcgcgggtacgtcgtcgggggcgccgcccagcagcagcgccgcccggcccgcgtcctgtttgcgcaacaggcggatcgcctcggccgccgaagccggtgtcgacaccgcgatggcgtccgcggcgacgccgaacgccgcggcgagcggaacctcgtagcccggagtcaccgacagcagttcggcggccggtcccagcaggccgccgaggcgatccttcgcccccaacagcgcgcccgtaccgtccttgcggcgcaggccgagcgccagcgcctcgcgccgggccgccgtcgccgcgcgcctgcgttccgccgccgtgaccgcttcacgggccgccgtcagggcggactccgcttcggacagggcgagcttcgccgcctcgtgccgctccgccaggtccgcgtcgcccgcgtccagcccgtcgacctcgtccttgagctgctcgtactcctcctgcgccgcgaccgcgcgctcctgcgcctcgtcccgcgcggacgcgagccggtcgatctcggcctgggcggaggccgcccgggaacgggccgcgttgacctgcccgttgaggcgggccagcccctcgcgccggtcggcgatggcacgcgccacgtccttcaggcgccgctcctcgaccgccagttcccgctccagctcggcccggtgctcgaccgtgtcctcaagggcccgctcggccgcctccagggccgcttcgagctccgcctcctgttcccggacccgtgcggcctcgcgctccatgtcctcggggtcgcggccacggcgctcctccgcgggcacggaggtggcgctcttcacgcgcgcgtccgccagggagacggtgccgcgcactcgctcggcgagctgcgacagctcgtaccaggtctgctgggcccgctggagacgcggcgtcagctgccgcacctcgtcctccaggagggcctcgcgctgcaaggccctcttcagctcggcctcggcggcctccttgcgctccttcagcgcggcctcgtcggcgacctccgtctggagcgccacccgcaggcgtacgaggtcgtcggcgagcagtcgcagccgggcgtcgcgcaggtcggcctggatgacggcggccctgcgggcgacggcggcctgccgcccgagcggcttgagctggcggcgcagctcgtccgtcaggtcctgcacccgcgcgagattggcccgcatcgcgtccagcttccgcagcgccttctccttgcgcttgcggtgcttgagaacgcccgcggcctcctcgatgaaggcgcggcggcccatggggtcggcgtggagtacggagtcgagctggccctggccgacgatgacatgcatctcgcggccgatgccggagtcggacaacagctcctggatgtcgaggagacggcaggtgtcgccgttgatctggtactcgctgccgccgttgcggaacatgatccgcgtgatggtgacctcggcgtactcgatgggcagcgcgccgtccgagttgtcgatcgtgagggacacctcggcgcggcccagcggcggacgcccggtggtgccggcgaagatgacgtcctccatcttgccgccgcgcagcgacttcgccccctgctcgcccatgacccagctcagggcgtccacgacattggacttgcccgagccgttggggcccacgacacaggtgatgcccggctcgaaccgcagcgtggtcgccgaggcgaacgatttgaacccgcgcagggtcagagccttgaggtgcacgccgccggactctacctttcgctccggtctcactccatgaacgcgcggtttcgcccctgaacgtgcagggcacaccatccgttaaaggaagtgggggtgcgcgggggaaagaaagaagggacgccgaggaggcgtcccttgcagatctgacaacttagcggttgatacgggccgcccaaccactgctgtcatggtgccgatgcagtgatcaggtgagcgcaggctccgcctggtgtgcgtcgatgctctccagaagcgagtcgtgagaagcggcagccgcgagcgcgtcgttctcggcctgaatccgtacgagctcggattcgaggtcctgtacgcgctgctggagccgtcgcatctcggcgatgagtcgcgggtcggagccgccgacgtaaccgagaagcgcctttgccatgatggatggtcctccacaatgagtgaccgaccgaagcggggtggtcgtgagggattcgcacccgcgatgcttggcactcttgagttcttgctgtcgttcaaccatgccaaacagctaaggtgcgcggggctttcagcgtctcaccaaaaagtttgacggtcaacacgatcacaccctgtattgacgggctacccgctgctgcgcggcctgcacggggcggcgtctgcgacttctgcgggccctgagggcgtggagatgatccttacctggggagcctgccacgacaagcggttcttggcaaccaccaggccatttctgcttcaggcatatgccggtggcatgacataccgctttcgcctgggctcttgccggcaggaccgtcagcggatcaagaagccgtcgtagctgccgcggggtgtgtcccacatctctgtgacaccgtccacccgcccgggcgtgtcgtccccctggagccagtcgagcagcccctggcaaccctcgcgcgcaccctccgcgacgacctgcacccgtccgtcgtccaaattgagagcaaaaccactcagcccgccgatctccaaggccttggcccgcgtgaaccagcggaaacccacaccttgcacacgtccgcgcacccacgcgacgagcctcacgtcctcgttcatgggtgcacgctaaccggccaatgtcccaaggggcacatcctcccctggcgccatgctgtaccgtcccgacccaatgaatctcatatgaaactcacccgatggtgtgagttctgtgaggacgttgaccgcaaggacgaggaaggccagaacatgggacgccaccgacgctccgccgccggccgcgccgccaccggccgcaccagcgaggtcaccaagcctcgcggcgacagcaccgagagctacggcccggagaacctgtacggcttcgccgcggttctcgaggccgagcgcgaacagcgttcccaccgtaagaagaaggtcgcgacgcccgtgcgcaccgggctgctcggcgtctccgcggccgtcgccctgggcacggtggcggtggccgccggagtactgccgggcggcggcaaatacacggtcggcgactccgactcggtgcaggccggcggttccccctcgggcttcgagacccagcagggcggcacgaacggcaccgcggacgaccgcgagtccacgtccacgagccgcggctccgaccgctcggcctcgccgtccgccgccccttcgactccgtcgaagaagccgtcgacgacgactccctcgaagaagcccgccccgacggcgacccagtccaggacggccactccgccgagcaaggcaccgaaggctccggaggccagcgcctcggtgacggtgtccaccgagaccgcggtcgcggccgaggtgctcaagctagtcaacgaggagcgggccaccgcgggctgcagcccggtggcggcgaacagcgcactgtcgcagctggcgacggccttcagcgaggacatggccgcgcgtgacttcttcgaccacaccgaccccggcggcaacgacccctgggaccgcgcggcgacggcaggtgtcaccggcctcggcggcgagaacatagcccgcggccaggccaccgccgaggccgtgatggagtcgtggatgaacagccccggccaccgcgcgaacatactgaactgcgacttcaagacgctgggcgtgggagtgcacttcggcgcgggcggcccttggtggacgcaggacttcgggtactgagtcagctgacgaacgttcgtaagcgcggcgggccgacgtgccggtcccggccggcggttggtggccggcccaggttgcggcggccaacgaacgttcgtacgccaaacaccgccgctccagttagctgacgaacgttcgtcagctaactggagcggcttacctgacgaacgttcgtcagctacgccgccgcacgccccagcgcgaacacccgcgccgcctccgccacccggcggccgaggtgctcggcggtggcgatgtcggccttgtggacggcctcggggccctcgtcgatgttcgtctgggcggcggcgccggcgaacacaccgagacggttcaggtcggtctcggcggccgtgctgctgttccagcccgggtgcaggccgaggttgatccagttcatgccgtgctgcgccgccaggatctggaagaactggagcgtgtgcagcttgtcgccgctcttggagccggagttggtgaagccggcggccagcttgtccttccagtcctgcccgaaccaccgcttcgaggacgcctcggcgaagacgtggaaggcgccggacgcggtgcccatgtaggtgggcgagccgaagacgatcgcgtccgaggcgtcgaggaccgcccactgctcctcggtgatctcgtcgacgttgatcaggtgcgcctgggcgccggcctcgacggcaccgctgcgtacggcctcggcgaggacggcggtgtggccgtggccggagtggaaggcgatggaaacgacgggcgtggtcacgatggggactccttgacagcggatcgagcagcacttcacgggaaccgctgctcgctagcgataaccaaaggaaagcactaacttgcagttagtgcaacctcctggttagcgctgtctcggagtatgctcatgtcatggaacccatcgcgcagcccgcccagggcatcgagaacggcgactgtccgggtctcgcgtacgacgtgttcgcccgcagctgcccgtcccggggcacgctggagcacgtcaccggccgctggggcgcgctcacgctgggcgcgctgcacgacggctcgttccgcttcaacgagttgcgccgccgtgtcgacggcgtcagcgagaagatgctgtcccagacgctgcacgcgctggagcgcgacggtctggtgcaccgcgacgcccaggccacgaacccgccacgcgtcgactactcgctcaccccgctcggtcgcgacgtcgccgagcgcctgctgacgctcatccggttcgtggagggccgcatggacgaggtactggtggcacgggagcgctacgacggggcccgcgcgtagctggaatcccgggccggcttctcacctggctgcgggctgtgcgggcaggttgaagacgtgccccggggtgacgatcttcgtgatcgcctcgccgaagagtgtgctgggctcggtgccggcgtggttgatgtcggtgttcagcagcacgacgagggttgcctgcgccgacgggagatagatggtcagggactcgtagcccggcagtgagccgttgtgcccgatccagccctggacgttgaagatgccgaggccgtatccggcccccgggatcgtggtggggggcgtgttgagccgttgcttctgcgtgacgggactgatcaggctgtcaccgtcgggcaggatgcccgtggccaccgtgcgcgcccatgtgcgcagatcgtccaggtcggagatcatcgcgccggccgcccaaccccaggaggggttccagtcggtcgcgttctcgacctcgccggtcgcggtctggtccgtgtatccctgcgcgtgcgggttcgggaaagccgcgtcggccgggagggacgtgtggttcatgccggccggctccaggacgttctgccgtatgaagtctccgagcggccggccgcctgccttctcgacgaccaggccgagcaggatgaggttggtgttgcagtaggagaacttctcgcccggcgggaacagcacagggtgcttgaaggcgtagtcgagcagctgctgcggcgtgaacgggcgccgcgggtcggacgtcagcgccttgaagaagccgtcgtcctcggtgtagttgaagagcccgctgcgcatcccggccagctcgcgcagggtgatcttgtcgccgttgggcacaccgtcgacgtacttgccgatcggatcgtccaggcccaccttgtgctcgtccaccagctccagcagcgccgtcacggtgaacgtcttggtctcgctgccgatccgcatgtacaggtccggcgacatccgctcgccgccgctcttgtccgcgaccccgaacgaccgtacgtgctgcccctggtcggacgtccacaggcccacggtcaccccgggcacgttcgcctcgcgcatgacccgccgcacggcctcgtcgacctgcttcgtcacggcaggagtgagggtgcggaaatcacccgtggaagccgacgcggaatcggacggcgtgggcggctcgacggcggtggcggaggctgtggcggcggcggtggcggaggccggcgcacctgaggcggccccgcccgcgaacggcaccatgagcgtccctaccgctatggcggtcacggcgcccctgcgcagtcgtacggtcgagtgcgtcatgggctgactccagccaaataaggacaaaacccacaactatcgtagggcgcattccctacccgggccattcgccgtgccacccgaagcatgtcccgccggaagcgcggccccacccggccccctgccccgtcaaccgcctacacggtgacgcgcggcgcccgctggcacttggggcagaagtagctggacctgttcatccacggccgtcgccgcatcggggtggcacagcgccggcagggcaacccctcacgtccataggcgtcgagtgagcggtcgaagtagccggactcgccattgacgttgacgtacaggctgtcgaagctggtgccgccgacggcgagggccgcgttcatcacatcccgtacgtggcccaggagttcggccgtacgcgggcgcgtgaagccggccgtggggcgctcgtagtggatgcgcgcccgccacagcgcctcgtccgcatagatgttgccgacgccgctgatcaacgactggtcgagcagggcccgcttgacggtcgtacgcttccggcgcagcgcctcgtggaaggcggcgtcgtcgaagagcgggtcgagcgggtcacgggcgatgtgcgcgatgacgtcgggcagaccgtcgggcgtggtgtcgtgcaacgagagcccgccgaaggtgcgttggtcgacgaagcggagttcggtgccgagggcgtcggcgaagcgcacccggatgcgcagatgcctctcgtcggcacagtcgtgcggctgcaccagcagctgaccgctcattccgagatgcgccaggacggccgtgtcggtcgtctccaacgggagccagaggtactttccgcggcggctcggcaccccgacccgccggcccttcaggcggtgcgcgaagtcctcgccgcccgcggtgtggcgtcgtacggcacgtgggtgcagcacctcgacatcggcgacggtgcggtgggcgacccaccgctccaggcctcgccgtacaacctcgacctcgggcaattcgggcatgacgactcccccacgcaccatagcgcccgccccggtcggggcgggcgctcggttgactgatcaggcggacgccgaggacgcgtcggcgtttccctgggcgcgctcggcggcctcggccgccgtctgagcggcctgggcggctgccttcgcgcgttcgtccgccgcggagcggatcgcacgccacgcggactccgcggcctgctgttccgcttccttcttgctgcggccggtgccggtgccgtacgagacgcctccgacgcgggcggcagcagtaaaggtcttctcgtggtccgggccggtctccgtgaccaggtactcgggcacgccgagcccctcggtcgcggtgagctcctggaggctggttttccagtccaggcccgcgcccagattcgaggacttctcgatcagcggatcgaagagccggtgaacgagttcgcccgccgcttcgagaccctggtcgagatagaccgcgccgatcaccgcttcaagggtgtcggcgaggatggatgccttgtcccggccgcccgtgccctcttcgccccggccaagccggatgaaggagcccagttcgagtccgcgaccgacctccgccagcgcacgtgagttgaccaccgcggcccgcagcttggccaactggccttctgggaggtcggggtgggtgcggtacagcgtgtccgtgaccacgaggccgagtacggagtccccgaggaactccagacgctcgttggtgggcaggccgccgttctcgtacgcgtacgaacggtgggtcagcgcacgcaccagaagggcggactcgagcttgtagccgagccgcccttccagaagcgtgtgggacgaggctgtgttgtccgcctttttcttggcggttgagtccgccttggcgtcagacatcagacctctcaccagccgctcagacctcgaggacctggcgcttgttgtaagtgccgcaagacgggcacgcaatgtgctgcagcttgggctcgtggcagcgctcgcacgcaaccagggtggggaccgcagccttccactgcgaccggcggtggcgcgtgttgctgcgcgacatcttccgcttcggaacagccacggctacttctcctgcttctcgtcgacgtgcgctgatggaagcgcgccgccgctcatctcgtccttctcgccgtcttcgagtgaaccggcgagtccctgcagtgccgcccaacggatgtcgacggcgtcatggtggtggtccgggtcgtccgcgagccgggctccgcattcggagcacaggcccgggcagtcgtcctggcacaccggctgcatcggcagtgcaagcaccaccgcgtcacgcagcacggtttcgaggtcgaacaggccgtcctcgagaaagagcctgtcctcgtcttcctcggcgtcgtcgaccggctccgccttttcgcggccccggtcgtcggcgtcagggtacgagaacatctcctggaagtccgcttcgagctgctgctcaagcggctccagacaccttacgcactccccctcggcctgtgcacgggcggtgcctgtgacaagcaccccttccatgaccgactcgatgcggagcctgagctccaccggcgcgccttccggcactccgatgactccctggatcccgagatcccggggagcgtcgatcgtgcgggtcaggcgctgcagcgcgccaggacgccgccccagctcgtgtgtgtcgaacacgagagggttgcggtggtcgaggcgggcgttcagggccattcctgctttcgatcttcgaaactcatgatgtcgccgccctgtgagttcccgggcagctgagatcgcggacgtacgcgcgaccgaacagccaggatactggacctttcgctctcggcccaatccggtggcgctcccgacgctcagtgaccgccgcgcccctgttcgtaggcccgcagctgctccgcactgatcatgctggtgtcgaagaggctggcctcgtccaggtcgtgtgcctgcggctgggagtcgtgcgtctgcggctgggagtagccctgctgctggttctggtcgtacgccgtctgctggtcgtagccctgctgcgggtacgcggcgtacgggtcggccgtcggctggtagccgtacgcgtcctgctggccgtactgctgctggtagccgtagggatcgggggtctgctgctggtacgcgtaggcgtcctgcccgccgtactgcggctgagccgggatctcaggggcctggggggtctggggcggtgccgagggctggtcgggggtgttgccgaggtccgccagaccggccaggtagtcggcgtcgctggtgtgctggacgggcgttccgtcgtccgtgagggcgcccaggtcgtcgctggcgatgcggccgtgcagcttctgcctgccgcggccgacggcctccagggtcttggcgaggacggcctcgaaggcgccgagcttgacgtcgacgtaggcgtcggcgttgtggcgcagggtctcggggtcgtggctgcgctcgggggcgtcctcgtcctcgaatccctgttcgtcgacgccgggcccggtgccgaggagcttctcgcggccgcggccgacggagccgagggtcttggtgaggacgacctcgaagttggcgagcttggagtcgacgtagtcgtcggcctcggtgcggatctcctcggcctcctggcgggcctcggagaggatgcggtccgcctcgttccgggagcggcgggcgacctcggtgtcggagatcagggagccgcgctcggcgtgtgcggtctcgatgatccgctcggcctcctggcgggcccgctcgaccatctgttcgcggtcgccgatcagctcctgggcatgggcgagggagccgggcagcgcctcacgcacctcttcgagcatcgagagcagctcggcgcggttgaccacgcaggaggccgacatgggcatggaccgggcgccggagaccgccgcgacgatctcatcaagcttcttctgcacgtccaccgtgtgctcgccactctctacagcttgatggagacggacgggtcgactgtacgaccagtcggcggccacccgacaccgggtgacgggctgtcaggttccgggggcttcccgggagacccctgagggcccccgggcctcccgcgagcttctcagtcctgcttgaggcgcccgttgagggcttccaggaccgccggcggcaccagatgcgagacgtcgccgccccaggccgccacctccttgacgagcgaggaggacaggaagctgtaggtggggttggtggggacgaagagggtctccacgcccgagaggccgatgttcatctgggccatctgcagctcgtagtcgaagtcgctgacggcgcgcaggcccttgacgatcgcggggatgtcgcgctgcttgcagaagtcgacgaggaggccgtggaaggactccacctcgacgttcccgaattccgcggtgacctggcggatcagctcgatccgctcgtcgacctcgaacaggcccttcttggactggttgatcatcaccgcgacgtgcaccacgtcgtacagcttggaggcgcgggcgatgatgtcgagatgtccgttggtgatcgggtcgaatgacccgggacagacggcgcggcgcaactgaggtccctcgctctccggtccggtcatcgtgcgtcttcgcacgtagaggcggcgcgaccgtaccaaaacgttccctcgccgtaacgacgggaccggatcggctcgaagccgtccggccaccggaattcgccgcctctggtgctgcgctccacggtgacgagggcttcgcccgcgagccagccccccgtgcggagtgtgagcagaatctcgcgaagatcgtcgtccgagaccgcgtacggggggtcgaggaagacgatgtcgtacgggtccgccgacgccggagtctggacgatctgttccgctttgcccgctctgacctcggcgccggggaggcccagcgacttcacgttctcgcggacggtgcggaccgcgcgggtgtcggcctccaccaggagggtgtgcccggcgccccggctgagcgcctccaggccgacggcgccggagccggcgtacaggtcgaggacccgctcgccgtccagcgggccgccgaggagggcctgccaggtggagaagaggccctcgcgcgcgcggtcggaggtgggacgggtgccgttgcccggcgggacggccagacggcgtccgccggcccgaccggcgatcacgcgggtcatgagggtcctttgcgctcgtgatgtgtcgggcccagtctgtcagcccttgtccaggtactgctcgcgctcctcgtccagcaaggcctccagggcggtgcgcaggcccgggaggtgccccagctccgggtcggcggcgaccactgcggccgcctcctcgcgggcctcggcgatgatctcctcgtcctcgatgacggcgagcatgcgcagcgaggagcggacgccggactgggcctggccgaggacgtcgccctcgcggcgctgttcgaggtcgatgcgggagagctcgaagccgtcgagggtggacgccaccgcgttcagccgctggcgggccgggctcgcctcgggcatctcggtcaccaggagacagagcccggcggccgagccacggccgacgcggccgcgcaactggtgcagctgggagacgccgaaacggtccgcgtccatgatcaccatcgcggtggcgttgggcacgttcaccccgacctcgatgaccgtcgtcgcgaccaggacgtccctctcgccggcggcgaagcggcgcatcacggcgtccttgtcgtcgggcggcatccgcccgtgcaggacctccacccccaggccctggagcgggcccttggcgagctggtccgcgacctccaggacggcgagcgggggccgcttctcggcctcgtcctccggggacttcttcttggccttcttggggtcgtcctcctcgtcaccgatgcgggcgcacacgacgtacgcctgatggcccttgccgacctcctcccgcacgcgctcccaggcgcgcgcgaggaagtggggcttgtcggcggccgggacgacatggctggcgatcggcgagcggccggcggggagctggtcgaggacggaggtctccagatcgccgaagacggtcatggcgacggtccgcggaatgggcgtggcggtcatgacgagcaggtgcggcggctgcttgcccttgccgcgcagggcgtcgcgctgctcgaccccgaagcggtgctgctcgtccaccacgaccagaccgaggtcgtggaactgcaccttgtcctcgatcagcgcgtgcgtgccgatgacgatcccggcctcaccggtgacgaggtcgagcagggcctgccgccgcgcggcggcgcccatggagccggtgagcagcacgaccttcgtggagtgctcggccccgccgagcatcccgccctcggccagctcgcccatcatctccgtgatggagcggtggtgctgctgggcgagcacttcggtgggggcgagcatggcggcctgcccgccggagtcgacgacggcgagcatggcgcggagcgccaccatggtgttgtgggtcactgtgaagttgtcagtgacataagcgtggctcgggtgaccgacactgatgcactgggccggtttgcgacctacgtactcgacggctcgaatgcctcgtcggaatgtgttgtatttcgggcgcgggcgcacgcgatcggccttacgggacagcctgaagggcgcgtactcatcagggagcgccaccgacacatggaacgcggccttctcgggcagcactcgcgcccggccccccagcgaacgcacgagccaggcgacatcctctgcgagtctgagcgatgcggagcggagagagacgctcatcccatccgcgtgcaccgtgccgtcagtgtccagaagcccttgcaggagcgagagacggttcttgatcgacgtgttcttgaagtcctcgggaatgaacttgccgtgggacgtcttaccccacagatccagcctgcgcagagcctggatgacaggattccgcacaccgccggagcgctgcttcagctggatggtgtagtcgcagcgggaacccgtcacgggaaccagccggcagtcaggtgccacggcatccgccgcagcgtcgcggatctcgtcatcgaccgtggacaaacgcagattgtgtcggaatgagccgtcgcccaacagcagcccgaaaagatagggatccagtggcaggccgacatccggtcccaggtcgaccggggtcgcggcagggacgtaccactttgacgacccgttcgccttgaacgtgtcgaggcggatctcccgcgtggtcatcaccttgggcgtctggccacgatgccacccgcaactcgtaccgacgatccagaggtgctcgtcgtcgcactccacggaacttccgtcggagagaacgatgcgccagacgtcacgcactccctgggggaataccccgtcgatcagtgcgatctctccgttgggcacgacaacctcgtcgccctcccgcaggtctcccatccgtcggaaacccgtgggggccagcaccagcgagtcgaggggctgagccttaccggaacccacctctccctggagcagccggtgcatcgggtgctcggtcgccaggtcgtcgaagatctccttggagaccttctgctggccttcggtgagggtgaaggggagcttggcgtcgaaggcggtgaggaggccgtcgggcttgggtttccttgccgcggccgggagttgggcgtcggcgtggcggcggcgggccagggccacctggaggacgaaggcctcgtcccacttcaggcgggcgcgggcgtcctcgatgtccgccttggtgtgggggcggtggatcttcaggagggcctcgggcagggagatcaggccacggccgtcccggagggagtcggggagcgggtcgagcgcctcctggacgctcggcagcaccgtctgcacggacttggcgatcttccaggactccagcttggcggtggccgggtagatcgggatgagggcgccggcccagctgtccacgctctccgcggcttcgtcgtcggcgccgcgcagcagctcgtacgccggatgggccagctggaggcggcggttgaagacggagaccttgcccgagaacatcgcgcgtgtgcccggcaggaggtccttgtgcggcttgtgcacgccgttgccgaagaagaccagctggaggcggccgctgccgtcggtgatggtcacttcgaggcgctggcccttgccgcggggtgccttggccgaggcgaaggtgtgcaggcgggcgtcggcgacctgggcgaccaccgtcacatgctcgtccatgggcaggtcggcgaggtgggtgagctgcccgcgctcctcgtacctgcgcggatagtggtgcagcaggtctccgacggtgtgcaggccgaggtgctcggccatcaccttcgcggtggcgggtccgagcaccttcttcagtggttcttcgagcgcgggcacgagatccattgcacaccacggcactgacattgccgtatacgccctggaaagccgctggtcagacggctcgttccggacccggtaccggtcgtcggggacccgtcgccggtccgcggggcgggcctcgtggcgtccggagcgtgcgctcgcaaggcgcggggaggtccgcgacgaggcccgcgaagggagtccccccggtccttgcaccttggcggaggagctgccgggccgttcccgcagcacggcgagcgtgtgcgccaggcgacgcgaggcaggcagaaatgcgagtacagggcctaagatggcgcgccccggccatcccctcgcggtcgcctcctcccgggaccgcccgaccccgcgccgtcgcccgtccccccaccaacggcgctgcgacgatggactcccagacctcacagtcatcccaggcatcccagtcaccgcatacgttccaggtcgacctgcgcggcctcgtggacctcctctcccatcacctctactccagtccgaaggtctatctgcgcgagctgttgcagaacgccgtggacgcgatcaccgcccgccggaccgagcagcccgaagcgcccgcgcgggtgcgcttgtacgcggagggcggcaccctgcgtgtggaggactccggcgtggggctcaccgagtccgacgtgcacagcctcctcgcgacgatcggccgcagttccaagcgggacgacggcctccaggaggcccgctccgactttctcgggcagttcggcatcggactgctggcgtgcttcgtggtcgccgagcgcatccgggtcgtgagccgcagcgcgcgtacgcccgacgcggcgcccgtggagtggacggcggccgacgacggctcgtacaccgtgcggacgctgccgcacgaggcgcgccccgagcccggtaccaccgtgcacctggtggcacgggccggggccgccgactggctgtccgcggagcgggtcctgtcgctggcgcgggacttcgggtcgctgctgccgtacgacgtccgggtgggcgacgaggcgatcaccgatctgccggcgccctgggaccgctcgtacccgagccccaccacccgcagggtggcgctggcgcggcactgccacgacctgttcggcttcacgcccctggactcgatcgagctgaacgtgccgctcgccgggatccggggcgtggcgtacgtgctgccgtccgcggtcagccccgcccagcgcgcgagccaccgtgtgcacctgaagggcatgctgctcaccgagcgcgccgaacagctgctgcccgactgggcgttcttcgtgcgctgcgtcctggacacggacagtctgcgccccacggcctcgcgcgagtcgctgtacgaggacgagacgctggcggcggtgcgggaggcgctgggcgagcggatacgggcctggcttacgggtctcgcggccggtgacccggatcgtctggcggccttcctctccgtgcactacctgggcgtgaagtccctggcgcggcacgacaaggagatgctgcgcacgatgctgccgtggctccccttcgagacgaccgacgggcggctgtccctggaggagttcgcgcagcggcacccggtggtgcacttcacgcggaccgtggaggagtaccgccaggtcgcgccgatcgcgtccgcgcagggcgtcggggtcgtcaacggcggctacacgtacgacagcgagctggtggaggcgctgccctcggtccgcccgggaacggtggtggccgagctggacgccgacacggtcaccgcccacctggacgcggtcgacccggccgaggagctggcgctgtccggcttcctgtccgcggcccgcgccaagctcgatcccctgggctgcgacgtggtcctgcgttccttccacccgctgtccgtgccggcgctgcacctggacgaccgggcggcccgtcacgagcaggcccgcgcggaggccgaggagcaggcggacgacctgtgggccggcatcctcggctccctgcggggcagtgccccacgcgcgcgtctggtgctcaaccacctcaacccgctgatccggcggatcagttccctggacgaccgggagctgatcggcacggccacggagtccctgtacggacaggccctgctgatggcccagcgcccgctgcgcccggccgactccgcgctcctcaaccgcgctttcataggcctcctcgaatgggccacccaccccagcttcccggaggacggtgcccgatgagccagaccatggacttcgacacgctgcgccgggcgatggcggacaactacgagcagccggagggccccgcccgcaacgcgcgcgcggagcagctgctcaccgaggcggagaagctgaacatcccgctcgccgtgatcgaggcgctcgggcaccagctgaaggtctacaactacagctccgagaaggacaagatgttcgtccccttcgcgcgtctgctgcgcatgtgggacgagcggcccgaggacttcgacgagtacgagatccactcgctgcactgggtcttcaagtggatgtcggcgggcatgctgggccagccgcacatcccgctcgcctccatagagaagtggctcggcgagatggagcaccgctaccgtctggccggccactccgaacgagcggtgcgcagcgccgagttcagcgtcgcgaaccacatcggggacctggcgcgcgccgaacgggcgtacgccgcctggctggccgccgaccgggacagcatggccgactgccacgcgtgcgagctgcacgaccagggctggtggcaggcgcgcaagggcgcggacgccgacgccctggaggtgtggcgcccggtcgtggagggcgagtacgtgtgcgcccacgagccgcacgcgatcctcgcctcctccctggtgccgctgttgcgcctgggccgcctggacgaggcgcgggcgcaccacctgcgtggcttcaggctgatccgcccgatggagagcatgcgcggtgcgtacgcggaccacgtggagttctgcgcgctctccggcaacgaggcacgcgccctcgaactcctggccgagcggcccgcctacttcacggactccggagagccgcgcagcaagctggacttcatggccgtggtggccctgctgatggaccggctcgtcgaactgggcctcggcgagcagacggtccccggtccggccggccgtgtgtggagcgcgcgcgaactcgccgcccacgcgcgcgcggaggcgctcgcgctggccgcccgtttcgacgagcgcaacggcacggcccacgtcagcgagcgcgcccgcgagcggatggaccggcgcccgctggtggaccggctgccgctgggcgtgcgctcgacgcgcccggcaccgacggcgccccggccgccggccgccccggactccgccccggccccggccgtggaacgggatctgcgggacgtactggccgaggcacgcggccgctcggacgcgctgcgcccggacgccatggacgcgtgggcggcggtggcacgcgccgccggggaccacgagctggacgcccgcgaccgcgcggagatcgccgaccacgaggcgatgagccgcggcccggagggcgccccgctcttcgaacgggcggccgagctgtacgcggaggcgggcgaccccggggaggcgctcgcggcacgcgcgcgtggagcgtacgtacgcgccctgacggggcactccgacgacgcgctgcggacgatcaacgacctgcaccggcaggtccgcgccctgttcgcaaaggacgggaccggggtgcggcagacggcggccgtgctggtgggacgggcgcgcattctggtgcaccgggtgcatgagacggagggcgcgggcacgaccgtggccgccgccgaggaggccgtacgggagctgctggagttcgccgagccgcacatcgcacaggtgcggctggcctcgcgggccgccgaggcgcgggcgatgctcggggagctggcggcactcaccggggacgcgatgacggcggcggagctgctggctcaggcggcggaaggtttcctcgccgccgggctgccgtggttcgcggtggaatacgaggcgcggctcgccgggatcgcccgggagctcggcgacgcggtggaggcggagcgggcggcgcgctcggcgctggagcacggtgtggagtacctggagccggcgggacaggcgcaactgcatctccagctggccgaagtgctgggcacgacggggcagttcggtcccgccgcggagcacgccctggaggcggcgcactgggccgacgaggcgggcgagggcccgacgttcggcgcctgggcacggcaccagctgggtggtttcctcctccagcaggggcggtgggccgaggcggcggaggtgctggagtccgcgctgcccgatctgaccgccgagacgcacggcgacggggcgctcgtgcagacccagtggtggctcggcgactgccacaccgagctgggggagcaccgggaggccgcggagcgctggctgcgggccgcggagatcgcccggcactggccggagcagcgtgaccacgcgatgctggcgcatctggccgcggaggccctcggccacgcgggcctgccggccgaggcggaccgggcgtacacgcgggccggtgacctctggcgcgacctgggcaacgtccacggcctggcacgtgccctgcgcgcccgcgcctggctcgcggcgcgggaggaggacgaactcgacccggcgcgggagctgatggcgcaggcggtgcgggagtgcgaggcggcgctggagggcgccaccgagggcgaggacggcgcgcgggagcgactcgtcgccgaactcggccacacccaccggcagttcggcgacctcgtcgcacggtcggtgcaggacggggaccggggcgccgacttccagggggcgttcgaggaggcgctgggccacgtcacgcgggcggtcgcggtgttcgcaccgctcggcgcgagcgcgctcgacctgcgtacgggcgcggaactggcggcgggctggctggaggccgacctccaccgccccgccgaggcgaccgcacgcgcgcgtgcggtcctcgcggcctacgcgaaccggcaggaggcggacgacgagacagcacgggcgcggtgcgcggaggcggaccggatgctggagctgctggggacgcggacgggacagtgacccgggtcgccgggtgcctgtcgcacggacgggcacccggcacacagcagctcctggccctttgccccctgctccacggcccttacgtccctaacggccctcacggccctcacggcccgcacggcccgcacggcccgcacggcagggcccttactccacgccgatcagcagcaacggcccctgacggccgccccggtacaccaccgtgtcgaccgccaggtaggactcccgtacccgggattccagatgcgccgcgatcgactccggagcctcgtcgccgagcaccagcgtgaccatctcgccgcccgccgcgagcatgcggtcgagaatgatctccgccgtctccgtgacgtcggagccgatcaccgccacgtcgtcctcgatcaggccgaggacgtccccggcctggcagatgcccgccatcgtccaggactgccgttccgcgacggcgacttcggcgtagcgggtcgctcccgccgccgacgtcatcgccaccacgtcctcgtcgaagcgccgctccggctcgtgcacggcgagcgccgcgatgccctgcaccgccgagcgggtcgggatcagcgcgacccgcaccccttccgtccgcgcctgctccgcggccgccgcggccgtgtggcgcagctccgcgtcgttcggcagcaggaccacctcgcgcgcgtgcgcccgccgcaccgcgtccaccagctctccgctcaccggtggctccccggcccgcgccagcacggtggtcgccccggcctccgcgtacagcccggccagcccctcccccggcaccacggccaccacggcccgctgagccggttcccgcggcggtcgcccggcgccgccggtgtgcacgtccccggccgcgaagtgggtgatccggatccggtacggccgtcccgcctcgaccccggcctcgacggcggcaccggcgtcgtcgacgtgcacgtggacgttccacaggccgtccccgccgaccaccacgagcgactcccccagcccgtcgagccgggaccgcagccggcccacggccgcgtcatcggcttcgagcagatagatcacctcgaacgcgggcccgccctccgccgggggtccgtccccgcactcccccgcgtcgggacgccccgccgcggcctcgtcgtccacgcgcgcgtggacgacggcccccgaggctcccggcgcctcccccgtgaaggtctgcaccagagccgccagcaccgccaccagcccccgcccgcccgcgtccacgaccccggcacgccgcagcacggccagctgaccgggtgtcgccgccagcgccgcacaggcaccctcgtacgccgcgcgcgcgaccgacccgcagccgtcctcggccccggtggccgcgtcggcggcggccgaggcgacggtgaggacggtgccttccacggggtgcgcgacggcctcgcgcgcggagtcggccgcgtgccgcagcgcgagccgcaggccctgcccgtcggtgtgcgcggtctcactgtcggcggcgagcacctgggccataccgcgcagcagctgcgcgaggatcgtcccggagttcccgcgggcgccaatcagcgcaccgtgcgccatggcctggaccgcgtcggcgagcgtcggccgccccggcccggcggaagcggcgtcggatgtcccgcccacggcgcccatggcgtcgtgcccggcgaagaccgcctcgaccgccgtggccgccgactccacggtcagatagaggttcgtcccggtgtccccgtcggccacgggatagacgttgatggcgtcgatctccgcccgcgcccgccccagcgcctgaagcgcgagaccgcaccaggtgcgcaccgcgagagcatcgaatgtctgcggcacctgcggcacctgcgcctccttgagctgctggactggacgcagcgtagacccagagcggggccgttccggaagagggccgcaagagcgccgcgagaccgccggggcgagggccgtgacgaagccgctggcaagggcgcgggccggccgcggtcaagggccgggacgagagcgaagggggcccggaggaggggccgccggggtggtccggctccggggcccaggtcggagcccctcgcagccatggtagtttcgttccacggacgcagtcgttgtatgctgctccggttgcccgatctgatcgggccttccccctggcaccgccactcagatcctccgatctcgattccggcatgccgggatcaaccgtaagtgcatctgaagtctttggagtgacccgtggctgccaactgcgacgtctgcggcaaggggccgggcttcggcaacaacatctcgcactcccaccgccgtacgccccgtcgctggaacccgaacatccagcgtgtgcgtaccgtggtgggcgggacgccgaagcgcgtgaacgcttgcacctcgtgcatcaaggccggcaaggtctcgcgctgacgtttctttagcgcgcggccactgctggttcgctgctcaaagccggtccactcgtggaccggctttttgctgtgccgacatacggccgagccgcgtccaccccggaaacccggggccggacgcggctcgacggcactccctactcgatgtccccgaagtggtcccagccccccttgctggaccacggcgccccgtccacggtgacctgcggcagcgccgacgggttgaggacctcgccgatcaccttccagcgggcgggcagcttcacgtccggcgggaaggtcgccacgatcgcgtggtcctcgccgccggtcagcacccactggatggggtcgaccccgacggcctggccgatgtcgttcatctgggtcgggatgtcgatggcgccggagcggatgtcgatccggaccttgctcgcctcggcgatgtgccccaggtcggcgatcagcccgtcgctcacgtcacacatcgccgtcgcgccgagcccggcggccgcgggaccggcgtgatacggcggctcggggcgccggtgcgcctcgacgaacgcgcgcggcgaacggaagccgcgcgagagcaccgcgtgcccggccgcggaccagcccagccagccggtcacggcgaccacgtcgccgggctgcgccccgccccgcgtcaccggctcgtgattacgcagatcgccgagcgcggtgatcgccacggtgatcgtgtccccgcgcaccacatccccgccgaccacggccgcgcccgcgacctggcactcgtcacgcaggccgtccatcagctcggacggccaggtggcgggaagttccgcgggtacgaccagaccgagcagcagcgcggtcggtacggcgcccatggcggcgatgtccgcgaggttctgcgccgccgccttgcgtccgacgtcgtacgccgtggaccagtcgcggcggaaatgccggccctccaggaggatgtcggtgctcgccaccaccctgcggtcgggcgcggctaccaccgcggcgtcgtcgccggggccgacccggaccgccggagtggtggtcaggcgcgaggtgagctctcggatgagcccgaactcccccaactcgccaacggtgcccttcattgtcgtattgccccttctatacctgtctgcgctgtacctgtccgcgctgcggcttgcgtgccgtcgtcggtgcggtcgcgagccgtcgatgtcctcggtacggtcgagtcgaccgtcaacttgtgtcgcccggatcttccggcgtgcacgccacagcccccgcgggtctccccgcagcgagcgacgacgcgataccgtggcgttccttttccccacatgatcctcgtggccgccctggaggttccgtggtacaggcgtacatcctgatccagacggaggtcggcaaagcgtcgaccgtcgccgagacgatcagcaagatcccgggggtgatccaggccgaggacgtgacaggaccgtacgacgtcatcgtgcgggcccaggccgagacggtcgatgaactcggccgcatggtcgtcgcgaagatccagcaagtggacggcatcacccgtaccctgacctgcccggtggtgcacctgtagcccccgtctacccttggccggtggacttctcccgtcaccggcccaacactttcttcgggctgcccgtgctcgcactgctgatcgccgccacgggctgctcctcggcagacgacaacgcctcggccacggttcccagcccggacgcgaaggtcaccgagctgtgccagaacctggacaaggtgctgccgaagaaggtggacggcctcgagcggaaagatcccgagccccggtccgcgctgaccgcgggctggggaagcccggcgatcatactgcgctgcggtgtggaacggcccgccgagatgctcgacccgaaggcgtccaccaccgaggtgaacggcgtgggctggctggtgcgggagcacgacgacggctcctacgtcttcaccaccagcctgcgcagggcatatgtcgaggtccggctctccgcggagcaggcgaagaacggcgccggttcgctcgtcgacctcgcgaagcccatcaagaaggcgatccccgaagggatcgccgactgacgtacgggtggacgactaacgcaagcccgtcgaacgccgcagcgccgcctccaccagacggtcgaccagctccgggtaggcgataccgctcgcctgccacatctgcgggtacatcgagatcggcgtgaagccgggcatcgtgttgatctcgttgatcacgaaatcgccgtcctccgtgaggaagaagtccgcgcgcaccaggccctcgcaggaggtggcctcgaaggcctccacggcgagccgccgcacctcggcggtctcctccggcgtcagcggcgccggcacgatgccgggcgtggagtcgatgtacttcgcctcgaagtcgtagtacgcgtgcgactgggccggggggatctcggcggggaccgaggcacgcggcccgtcctcgaactccaggaccccgcactcgatctcgcggccgcgcagcagcgcctccacgatgatcttcgggtcgtgccgctgtgcctccgcgaccgcctcgtcgaggccggcgaggtcgtcgaccttggtgatgccgatcgaggaacccgcgcgtgcgggcttcacgaacaacggccagccgtgctcacccgcgaagtcgacgatcttcctgcgggcggcggactcgtcgcgctcccattcgcgcggccggatcaccacgtacgggccgaccttcagcccgaaggaggtgaacacccgcttcatgtactccttgtcctggccgaccgccgaggcgaggacgcccgcgccgacgtacgggacgccggacagctccaggaggccctggagggtgccgtcctcgccgtacgggccgtgcagcacgggaaagaccacgtcgacctcgcccagcgccttggggaccgatcccggctcgctgtagacgacttcgcggttggccgggtcgacgggcaggatgaccccgccctcgttcgactcggcgagttcctcgacgctgggcgtacggcggtcggtgatcgccatccgctccggctcgtcggcggtgagcgcccagcggccgtcccgggtgatgccgatcggcaggacgtcgtacttcgtccggtcgatggcgcgcaggacggcgccggcggtgaccacggagatcccgtgttcggagctgcgaccgccgaatacgacggccacacgcggcttgcgaggcggctgctcggggctctgggggaggttctcggtgctcatatcgcgttgagagtacccgctggtacggcggtgagtcagcgccccacggcggccgttgtccagcatcgcgcggacggtcgctcagcgtcgtaccggccgttgcggagcgtcgcgcacgaccggtcgctcgcggtcgctcagcgccgctccggcttcgcgctgcgcgacatcagctccttgagggcgacgaccggcggcttgccctcgtggacgatgccgacgaccgtctccgtgatcggcatgtcgacgccgtgtctgcgggccagatccagcacggactcacaggacttgacgccctcggcggtctgcttggtgaccgcgatggtctcctggagggtcatgcccctgccgaggttggtgccgaaggtgtggttgcgcgagagcggcgaggaacaggtcgccaccaggtcgcccaggcccgcgagaccggagaacgtcagcgggtccgcgcccatgaccaggccgagccgggtggtctccgcgagtccccgcgtgatgagcgagcccttggcgttgtcgcccaggcccatgccgtccgcgatgccgacggcgagcccgatcacgttcttgaccgcgccgccgagttcgcagccgaccacgtcggtgttggtgtacgggcggaagtacggcgtgtggcaggcggcctggaggcgctgggcgacggcttcgttggcacaggcgaccacggcggcggccggcatgcgggcggcgatctcccgggcgaggttgggcccggtgaccacggcgatacggtccgcgccgaccttggcgacgtcctcgacgacctcgctcatccgcatcgcggagccgagttcgacgcccttcatgagggagacgaggaccgtgtcgggtgcgagcagcggcacccattcggcgaggttcccgcgcagggtctgcgaggggacggcgagcacggtgaagtcggcggcgcgcgcggcctcggcggggtcggtggtggcccgcaggttctccgggagttcgacgcccggcaggtagtccgggttcgtacgcgtggagttgaccgcgtcggcgagttcggcgcggcgcgcccacagggtgacgtcgcagcccgcgtcggcgagcaccatgccgaaggccgtaccccacgatccggtcccgaagacggctgccttgaccggcgtgctcacgtgctctgctcctcttcctgctgtgccctctgttgcgctttctgctgcgcctgcgctctttcgtaggccgcggtccgccggcgctgttcgatgcgcacctggcgcgggtcgtagggcctctcgggcgccttctcgccgcggatctcctcgagctgcgcggtgacggccgccatgatgacctcggtcgcctccttcaggaggtccgggctcatctcccggtcgtagaagcgcgtgaggtccaccggcgggcccgcgagcacgcggtgggtcttgcgcggaaggaggttgggcttcttggcatacggcggcagcaactcgttggcgccccactgggcgaccggaatcaccgggcacttggtctgcagagcgacgcgggcggcaccggtcttgccggtcatcggccagccgtcggggtcgcgggtgagggtgccctcggggtagaaggcgacgcattcgccgcgctccacggcgtcgatcgcggcccggaaggcgctcagcgcatcggtgctctcgcggtacacggggatctgcccggtgccccgcatcgcggcccccacgaatcccttcttgaaaagcccggccttcgccaggaatcgcggaacccgcccggtgttgtactgatagtgggcatacgcgaaggggtcgacgtgggaattgtggttgaccgcggtgataaatccgccctcgaccggaatgttctccattccgcgccagtcccgcttgatcagaaccaccagtggcggtttgcagaggaccgctgcgaagcggtaccagaagctgattctgcggcggggcacgcggacaccttcctctagggcctggggggccgcacaagtgtcgccccaggccgcctgtctgtcgagaacaccgtacgccccggcaccgtgcgccccatgggggccgggtcacaatgggcgcgacaagggagggacggagcgctcgtgcagtggaccttggtcgtacccctcaaagccctggcgcgggccaagagcaggcttgcggacaccgccggggacggactgcgccccggactcgccctcgccttcgcgcaggacaccgtggcggccgcgctcgccagcgccgcggtccgcgatgtggcggtcgtcacgggcgatccggtcgccggacgcgagctggccgcgctcggggccaggatcgtcgccgacgaaccggcgggcgggctgaacgccgcgctggcgcacgcggccgcggtcgtacgctccgggcgccccgacagcggcgtcgcggccctgaacgccgatctgcccgcgctgcgccccgcggaattggcccgggtactggaagcggccgtcgaattcccgcgcgctttcctcccggatgccgccgcaatcggtacgactttgctggccgccgctccgggtcgcgaattgctccccgctttcggtaccgattcccgggcccgtcatcgcgcctcgggggccgtggaactcggtctgggcggggtgaactccgtacgccaggacgtggacaccggcgccgacctgcgcgcggcgctggcactgggggtgggcccgcgcacggcagcggcggcggcccggctgctgatcccgggcccccagggggatcgataggctgccaccatgcaggcgaccgcgtacacgtacgactccgagacccgcagcggccaggtgctgctcgacgacggcacccccctgcccttcgacggccccgcgttcgacgcgggcgggctgcggctgctgcgcccggggcagcgcgtgcggatcgaggtggacggcgagggcgacgcccggcgcatcaccctggtgaccctgcagacgttctgaacgtccccggacacgccgcgggccgggctcccgaggggagcccggcccggcgcgtgagtgccctgtgcccttgcctgccttgctgtctagcgggcggtggccttcttggcggtggtcttgcgcgctgtcgacttcttggcgggggccttcttggccgtcgccttcttcgccggggccttcttggccgtcgccttcttggcggtggtcttcttggccgcggccttcttggcgcccgccgtggtcttcttggcggtcgtcttcttcgccgtcgccgtggtcttcttggcggcgggcgcggccttcttggccgtggtcttcttggcggtggtcttcttcgcggccgccgtcgccttcttggcggtggtcttcttggccgcggccttcttgaccgtggccgaagcggcgccggtcaggctgcccttgggcgccttcttgaccgagacctcaccaccgcgcgggagcttcttcgacccgctcaccaggtccttgaagccctggccggcgcggaagcgcggcacggaggtcttcttgacccgaacgcgctccccggtctgcgggttgcgggcgtagcgggccggacggtccaccttctcgaaggaaccgaagccggtgaccgaaacccggtccccgccgaccaccgcgcggacgatggcgtccagtacggcgtcgaccgcgtcggcggcctgctgacggccgccgaccttgtccgcgatcgcttctacgagctgcgccttgttcacgtcttccccttcggagaccttgccagaacgtaagtgttcaagcgttttcgcacgttaggcagatatataccgcaaatcaaacacgaaacgggctaatcacccttgtgccgcaacgaactcggcagtctcggacttgttcagcgttcctcttcggggattcgaccctcgtcgaggtcggtcatgaaccgctccagacgccttgtcgcatcggcgagatcgtgtttggccacggccgtaatgaccagcagcttccgggtcagcgccatccgtacgccctccgggacttgcagtgcgcgcactgttgtgtgcgcttccttgagttgggccgcgactgccgtatagagctcgagttggccgtcgtgttccatgcacagattgtgccatctggggcgagttgtcgcctgcgcagggggcaactaccgcctcaaacggccttccgggcacctgccgaagccgcgatgtcaagactcgggtacccggccaacaccccttgtaacgtgggaagttggcagcccgatcgaggcgtgcggggcggttcggacgcagacatggctgtacccccaaccgtccacgattgggggtacagacaggggttgcgggtggccgaaaccagtcgtcggaaggcccgtcgacgggccttccgacggcccggggatcagacctggagcgtccgcggcttgtgcgacggccgcttggcctcgtacgtcgcgatgtcgccctcgttctggagggtgatggagatgtcgtccaggccgttcagcagccgccaacgggcgttctcgtcgagctcgaaggccgccgtgatgccctcggcgcgcacctcacgggcctccaggtcgaccgtgacctcggcctgcgggtccttttcggtgagttcccacagcgcgtccacgatcttctgctccagaaccactgtgagcaggccgttcttgagcgagttgccgcggaagatgtcggcgaagcgcgaggagatgacggccttgaagccgtagttctggagcgcccacacggcgtgctcgcgcgaggaacccgtaccgaagtcggggccggcgaccaggaccgtggcacccgtgcgctcgggccggttgaggatgaaggactcgtccttgcgccaggcctcgaacagcccgtcctcgaaaccgtccctggtgaccttcttgagccagtgggcggggatgatctggtcggtgtcgacgttgctgcggcgcagcgggacggcccggccggtgtgcgtggtgaatgcttccatggcttctcagactccagcgggcgtacgggcggcgttctcgtcggccaggtcggccggggaggccaggtggccgagcacggcggtggcggcggcgacctgcggcgacaccaggtgcgtacggccgcccttgccctgcctgccttcgaagttgcggttggaggtggacgcggagcgctcaccgggggccagctggtcggggttcatgcccagacacatcgagcagcccgcgtgccgccattcggcgccggcctccttgaagaccacgtccaggccctcggagacggcctggagaccgacccgcgccgagccggggacgatcagcatccgtacgccgtcggcgactttgcggccctcgacgatcgcggcggccgcacgcaggtcctcgatgcggccgttggtgcacgaacctacgaagacggtgtcgaccttgatgtcgcgcagcggctgcccggcggtcaaccccatgtattccagggccttttcggcggcgaagcgctccgaagcgtcctcgtacgaagcggggtcggggacggacgccgaaagcggcgcgccctggccggggttggtgccccaggtgacgaacggcgacagcgcggcggcggcgatgacgacctcggcgtcgaattccgcgtcctcgtccgacttcagggtcttccagtacgcgacggcggcgtcccactcctcgccctcgggcgcgtgggcacggcccttgaggtacgcgaaggtggtctcgtcgggggcgatcatgcccgcgcgggcgccggcctcgatcgacatgttgcagatggtcatccgggcctccatcgagagcttctcgatggcggagccgcggtattccaggatgtagccctggccgccgccggtaccgatcctggcgatgatcgccaggatcaggtccttggcggtgacgccgtcgggcagctcgccgtcgacggtgatggccatggtcttggggcgggccagcggcagcgtctgggtggccagcacgtgctcgacctgcgaggtgccgatgccgaacgccagcgcgccgaaggcgccgtgcgtggaggtgtgggagtcgccgcagacgaccgtggtgccgggctgggtcaggcccagctgcgggccgacgacgtgcacgacgccctgctcgacgtcgccgagcgagtgcaggcgcacgccgaactcggcgcagttcttgcgcagcgtctccagctgggcccgggagaccgggtccgcgatgggcttgtcgatgtcgagggtcggggtgttgtgatcctcggtggcgatggtgaggtcgagacggcgcaccggacgccccgcctggcgcagaccgtcgaaggcctgcggactggtcacctcgtgcagcaggtgcagatcgatgaagaggaggtcgggctcgccctcggcgcgccggacgacatggtcgtcccagaccttctccgcgagtgtcctacccatcgctttccctccggccggcctgtgtcggcgccggcccaactagagatcttcggggcggcaacgctcgtacccctcgtaccgcgcgtccgccgccgggcccgttggtctgcgggccgctgtatctaccagggtggcgtgttccacgcgaaattgaacttgcgtttcacagagtgagacgcgagtatcgttgcatggacaacagtagcggcgtcggcgtgctggacaaggcggcccttgtcctgagcgccctggagtccggcccggccaccctcgcgggactggtggcagcgaccggactggcacggcccacggcacatcgcctggccgtggcacttgaacaccaccgcatggtggcgcgtgacatgcagggccgtttcattctcgggccccggctggcagagctggccgcggcggcgggcgaggaccgtctgctggcgacggcgggcccggtgctcacccacctccgggacgtcacgggcgagagcgcgcagctctatcgccgccagggcgacatgcggatctgcgtcgccgcggccgagcgcctgtcgggcctcagggacacggtcccggtcggctccacgctcaccatgaaggccggttcctcggcgcagatcctgatggcctgggaggagccggagcgcctgcaccgcggcctccagggcgcccgcttcacggcgacggccctgtcgggcgtacggcgccggggctgggcccagtcgatcggcgagcgcgagccgggtgtcgcgtccgtctccgcccccgtacgcggcccttccaaccgggtggtggccgccgtgtccgtctccggccccatcgagcgtctgacccgccacccgggccgtatgcacgcccaggcggtcatcgacgccgccgggcgcctgtccgaggccctgcgccgcacgggctgacctgagcgatcgagtacgtcatcgggggcgggcccgcctcaacgccgcggcaggccctcccccggcatccccctcaggcggaccggtgcgcgaaccggtccttcgcccgccgcccccgcttctcgacgggcagcaccccgtgcgcggccgcaagcccgaagggcggcatgtccgcgtagatcgactcgtacgacccctcgggcgcgacatacgtctcgtgccacagccccacgtgcccgcgcgcctttcccgcgcgctccttgcggttgatgatcgcccaggcccggtggtggaacatgtcgggtgacgtcgcgtacgcgtagagcttctctttggactcccagtactggaccacgtagtaggtccgcggtgaggccgtcagcagcacatggccgagcagtccgcggctccggtcccgcgtcagctcgcgcagcatgcgcggcatcgcgaggaagaccggcagccactggtgcacggcccagaggtggttgatgcgcatgccgatcagcagcacgaccacgtccccctcggcggctgcggtggtgcggcccgcgacgggcttggcgaacatggcggccccctgtgttggtgaagggcactatccaaggccccgtgcttggatagtgacgctaaccaaggaagggcgcaagagatgcggctggccgagttgagcgagcggagcggtgtacccctcgcgacgatcaagtactacctgcgcgaaggcctgttggcgccgggccggcgcatcagcgcgaccaccgccgagtacgacgagggccatctgcgccggctgcgcctggtccgggcgctgattcaggtcggccgggtcccggtggcgacggcccgggaggtcctggggcacgtcgacgacgactccctcggccgcacgatccggctgggagcggccctgtgggcgctgccgcaggttccggagccggacgaggaggacgagaacgtccgggccgcgcagcacgaggtggatcagctcctgcggacgctggactggacgaccgcccagaacctgagcagcatctctcccgcgcatcgttcgctggtcgtggccgtggccacactcaggcggctcggctacgcctgggacgccgaactgatggcgccgtacgcccagttgatgcatcaggcggccgtccgggacctggacttcgtggagacccatccgtcggaggccgagaaggtcgagaccgcggtcgcggcggcgatcctcttcgaaccggtgctgcgcgcgttgcaccggctggcgcaggaggaggagtcggcgcggcggtacggcatcgagtgagcgggaacggcgaaggccccccaccgaagtggagggccttcgcctcacgtacccccgaccggattcgaaccggcgctaccgccttgagagggcggcgtgctaggccgctacacaacgggggcaaggaccacgagtgatccagctgggctaccaggactcgaacctagaacaacggaaccagaaaccgtcgtgttgccaattacaccatagcccaatggtggtctagaccaccgagtacccccgaccggattcgaaccggcgctaccgccttgagagggcggcgtgctaggccgctacacaacgggggccctagcgatcctgcatgagagtcagcgggtgcgacccggactgcccccctgggaaggatctgtacccccgaccggattcgaaccggcgctaccgccttgagagggcggcgtgctaggccgctacacaacgggggccttgcagagttggttctctgcgatgcagataagctctgcgagctggcctaccaggactcgaacctagactaacggaaccagaaaccgtcgtgctgccaattacaccataggccactgaaacgcaatcccttgcggggatcttgttttagcttgcgcctccggtttccggcctttcggcccgctccccggcggcgcagaaagaacattacccgaaggtggacggcactccaaaacgggtatccgcgccgaggacggcggggagttcggccagcgacgcgatccggtgcgggccggtggacgcgacggcggtggcggtgtgagcgccgtcgcggtcgatccagacggagagcagtccggcctcggcggcgccgcggccgtcgatctccgggtggtccccgacgtacgcgacctggtgcggcggcagcccgagcgcgtcgcaggccgcgtggaaggcctccgcggcgggcttggagacgccgagctcggccgcgcacaggacggcttcgaagcggtggtgcacgccgaggacccggagcttgcggtcctggacgtggaggctcgagttggacaggaccgcgtgccggtgactggcggcgagggcgtccaggacgggcagtacgtccgggaagagggcccaggcggcctcgtagtacgcgacgtagcgctggaaccagtcgtcggcctcggtgtcggtcagcggctgcccgaggaacacccggacgcgttcgcggcgctggccctcccagtcggtctctcccgccgagaacctcagccactgctggtcggtgacctcccgccagcgtgccagggcctgctcgacggactcgtatccgtcgagcaggccctcggccgccagatgttcgcgcatcccggctcggtccgcggcgccgtagtcgaagatcgtgtcgtcgatgtcccagaccacggcgctgatgtccatgagccgacggtaacccgggggtgggcgccgcgtcggccggttgacggcagtcgtgccggtcagggtcaggccggggccctgggcgtcgtcctggtcggcggtgcgcagcacggtcgccgtccgcgtggtcgccgtacccgtggggaagtcggtgagcagtggttcgtgcgtgccgcggttctcgcggatcagacagccgtcggcgaggcggtcccggccggccgggaccgtgaggggacggttcgtggcgcggtcgtggacgccggcgggtccaaaggcgccgcaggaccggtacagccaggtgttgacggcctgggtggcgctgggcgtgcggggcgcgccggtggcgacgcgggcccggccggcacggcgcacgacagcgccgcggccccgctgaggcaagccttcgtgaacgggtcaccgctccaggagcggcagttcgctggaggggggaactccggatgacggctcggagcatacgaagggggcggcgtccggaccggacgccgcccccttcgtgcctgcgctgtgcggctacgccgtcagcttcgccagtgccgcgtcgacgcgggccagcgtcttctccttgcccaggatctccagggactcgaagagcggcaggccgaccgtgcggccggtgacggcgacgcggaccggggcctgcgccttgccgagcttgaggccgtgctcctcgcccgccgccaggacggcttccttcagggactccggagacgtccagtcggccgcctccagcttctcccgggccgtgcgcagcagtgcgtccgagccctccttcatggccttcgtccaggacgcctcgtcgaagaccggctccggcaggaacaggaagtcgacgttgtcggtgatctcggagaggaccttgaggcgggactgcgcgtacggcgcgatgacctgccacttcgcctcgtcgaagtcctcgggcgcccagttggcgaacggggccttcagccacggccggcagcgctcggtgaagtccttcacatcgagcagccggatgtggtcggcgttgatcgcctcgcacttcttcaggtcgaagcgggccgggttggggttcacgtccttgacgtcgaaggcggcgaccatctcgtcgatcgtgaagatgtcgcggtccgccgagagcgaccagccaaggagagagaggtagttgagcaggccctccgggaggaagccgcgctcccggtagaggttcagcgaggcctgcgggtcacgcttggagagcttcttgttgccctcgcccatgacgtacggcaggtggccgaactccggcacggacttcgcgatgcccagctcgatcagcgcccggtagagggcgacctggcggggagtggaggagagcaggtcctcgccgcgcaggacgtgggtgatctccatcagcgcgtcgtcgaccgggttgaccagcgtgtacaggggcgcgccgttggctcgtacgatcccgtagtccgggacgttctccgggaggtacgtgatgtcgccgcggaccaggtccgtgaaggtgatcggctcgtcgggcatccggaaccggacgatgggcgtgcggccctcggcctcgtaggcggccttctgctcggccgacagctcccggcagtgtccgtcgtagccggacggcttgccggcggcgcgggcggcgtcgcggcgggtgtccagctcctccgtcgagcagtagcagtggtacgcgtagccgccgtcgaggagcttctgggcgacgtccttgtagaggtccatccgctgcgactggcggtacggcgcgtgcgggccgccgacgccggggccctcgtcccagtcgaagcccagccagcgcagcgagtccagaagctgctcgtacgactcctcggagtcacgggccgcgtcggtgtcctcgatgcggaagacgaaggtgccgccggtgtggcgggcgaacgcccagttgaacagggccgtacggaccaggcccacgtgggggttgccggtcggggagggacagaaacgtacgcgtgggggcaccccctctccgagcggagtcgaggacttgggggagttcgcgttagccacgcttgatcaccttgttggtgagagtgccgatgccttcgatggtgacggcgacctcgtcgccgacgttgagggggccgaccccagccggggtgcccgtgaggatcacgtcgccggggagcagcgtcatggcctcggtgatgttgacgatcagatcctcgatcgagtggatcatctcgctggtgcggccgagctgccgctgttgcccgttgaccgtgagctggatggtgacgtcgctcgggtcgaggtccgtctccacccaggggccgagcgggcaggagctgtcgaagcccttggcccgggcccactgcttctcgcgcttctggacgtcacgcgcggtgatgtcgttggcgcaggtgtagccgaggatgacgtccttgacgcgctcacgcggtacctcgcggcacatgcggccgatgaccaccgccagctcggcctcgtggtgcagctcgttcgagaaggacgggtactggatcgggtcgccggggccgatcaccgaggtcgacggcttgaagaaggcgaacggggcgtcgggcacctcgttgcccagctccttggcgtgctccgcgtagttgcggccgaaggccacgaccttgttggggagcacgggcggcagcaggcgcaccttgttgaggggaaccttcgtaccggagagctcgaagtccgcgaacgggatgcccttgatgatgtcgaggacgagctcgtccggcttgtcgccctcgaccgcgccgaaagcgacgttgccgtcgatggagaatctggcgatgcgcacgggatccttgcgcccctcactgagctggctggagtctgacgctccaggctaacgcggtgggggcggcaggctcgcgcattaccggcgggcgccctcggagccgtgcgcgatcacgcccgcccattcacagggaacaccttgagcgggcggcgcccggtgcgcgtactactccgcgacggaagccgtgacgggggcctccatcaggatggtgcgtcggggattggcggtctgggtgggaagatcgacggagtgttccggctggtccggcgtgtgcagctcgtcggcgtcggtgaggtgcgccagcgtggtgcgtcgcgggttggctatgttgcggaacatcgtcgtcgtcttcactggagttcgtgacctcgtcggtacgggcgccgggcagggtccaaggaccgccgcagaagcgcaggttgtcggattcgccatccctgtaaagcgtcaggctaaacattcaattccctggcgaaggcgtgaagaggtcatgatccccgtgtgagtttgctcactgactactgggcaaaagggtcaatccggaccgccaactcctcgcgacgaaacggacattgccccactgaagcgcgcattccgctcctgatcatggcgactgggacaccctgcgcacctcgatgactcgcccgcttatgcccgatatatataagtccactttctacgtctcgtgacgctcccctcacaaggggtcacggtcgtcacgggctcgcccatgggccttgttggagatccggcactgtgctggaattccacggaccgccgcgggatcgagatccggcgcgcaggggcgcaacgcagcgccagtggcggcgggaagggggagcccagcgccggtcactcacgaccaccatgggtgcgcattgagggcactcccacgacgccgacaccgtcccgccgttcacgcggagggacgcctggtccagaggttgcgacgctagtgcagggacgtttcaagagggatggcagcgcttcggcggagccggagccgcacggcgggaccgaccgcggttcctcgccccagcacgcccagaacccgggaccgggtgaggccggcaagagcggtgggcgcaccggtgcgcccaaggcccccactccacccgcgaagccgacgagcagcggccccagcagcggctcgcgcgtagctctgcgcaactggcgcatctccacgcgtctggtctcgctgctcgcgctccccgtggtcgccgcgacctcgctcggcgcgctgcgcatcagcgactccatggacgagatccagcagctcgacaacatgaagctgctgaccgacatgaccaagcaggcgaccgagctcgccgccgcgctccaggacgagcgcgaccagtcggcaggtccgctggcgcacggcgccacggccaccgacttcacggtcaagggcgtccgccagaagacggaccgcgcgcgctccgccttcctctcgggcacccaggagatcgacgacgccagcggcaacggccagctctccggcgtccgcgacagcgtcgtgggtctggccggtgagctgagcaacctgagcagcatccgcaacgtcgcctacaaggactccgagaacgccacgcagacggtcgagggctaccaccgcctcatcacccagctgctcggcctctcgcaggacatggccgaggcgaccagcaacccggagatgatccagcgcacgcgcgccctggcggccttctcgaccgccaaggagtacgcgtccgtgcagcgcgcggtcatcgcggcgtcgctgcccgcgagcaacaacaccttcggcaagctctccgagaacgaccgccagtacgcgctctcggccctggacagccaggaatccgagatatcgagcttcaacagcatctacggcgacggctacgaagatctgacgaagcccatcgacagcggcaacccgaccatcgaggccgccgacgagtacgcgaagcgcgcgctgagcgacaagaacggcatccgccagcagaacaagcgctcgtacaaggactgggtcgacgacgactcggccaagctcgagcagatgtcgaagatcgagctcaccctgctcaaccagatggagcagaaggcccgcgagctgcgcaaccagtccgagcaggaagcgatcatctcgggtgcgctgatcctcatcgtcctcggcgtctcgctcgtcggcgccttcgtcgtggcccgctccatgatccgctcgctgcgccggctccaggacaccgcgaccaaggtcgcccaggaccgcctgcccgagctggtcaggcagctgtccgagtccgacccgcaggacgtcgacacgtccgtggagtcggtcggtgtgcactccaaggacgagatcggccaggtggccgcggccttcgacgacgtgcaccgcgaggccgtacgactcgccgccgagcaggccctgctgcgaggcaacgtcaacgcgatgttcaccaacctctcgcgccgctcccagggcctcatccagcgtcagctctcgctcatctccgaactggagtcccgcgaggccgacccggaccagctgtcctccctgttcaagctcgaccacctcgcgacccgcatgcgccgtaacggtgagaacctcctcgtgctcgccggtgaagagcccggccgccgctggacccgcccggtcccgctggtcgacgtgctccgcgccgccgcctccgaggtggagcagtacgagcgcatcgagctgtcctcggtcccgaccaccgaggtcgcgggccgggtcgtcaacgacctcgtgcacctgctcgccgagctgctcgagaacgcgacgtcgttctcctccccgcagaccaaggtcaaggtcaccggtcacgcgctgcccgacggccgcgttctgatcgagatccacgacaccggcatcggcctctcccccgaggacctcgcggcgatcaacgagcggctcgcggcgccgcccaccgtggacgtgtcggtctcccgccgcatgggtctgttcgtggtcggccgtctgtcgcagcgccacggcatccgcatccagctgcgtccgtccgactcgggcggtacgaccgcgctcgtcatgcttcccgtcgatgtcgcccagggcggcaagaaggttccgggcaagccgggccagggcgctcccggcatcggcggcccggctgccgcacaggcctcggccggtgtggccgcggcccgtcgcggcggtcagtcgggcagtccgagcctcggcgccggtgcccccgcgggcaacgccggccgtatcggtgcggctccgcagcgcggacaggtgggtgccggtcagggcccgcgtgccgcactgcccggcagcaaccagggcggacgtcccggcgcgccgggcggagcccggggtccgcagcagggtccggcggcaccgcagcagggccggccggcccccgcgggtgccggtgcgggtgccggtgccttcgggcagaacgcgccgggcgccccgcagggcctccaggcggcgcaggccttcaacgagggcccggcggccacccgtcagggcggcttcggcgacggcggttccggcacgcgccggggcggcggcttcggcgacagcacccccgcggccgcacccccgcagcagccccagcagcctcagcagcagcccaaggagtcccgtcgccgcaggccgcagctgccgggtcgcggtggcccgcgggccgaactgcccggcggcagcgcccagccgcgcacgcccagctggagcgacgagaacgcgcagccgccggtgccgcgcgcctcgctcgacgccccccgcggccacgaggagccggacgcgctgtccgccacctcccggctgccgcgcgtcgacgaccgccagggacccggcgcgacctcggagatcccccggatcgacgaccgccagggacccggcgccacttctgagttcgcccgtcccgacttcgacaccacgcgccccggcgcggaggcgccgcagggcggcaacgggcagttcggccgcccggacatgttcggcaccggcaaccaggcggcacccacgaaccggttcccggctcagggccgcccccaggacgcgtcgcccaccggacagccgccggcctacggcggctcccaggacccgtcggccaccggccagttcgcgacgccgggctacgacggttccggcacgggtcagtacgcgacgccgggctacgacgcgtccggcacgggtcagtacccggcgccgggccagggcaaccgccaggactcctcgtccacgggccagttcgagcggccgcaggccggtggccccgccgacttcggtgtcccccggccgccggccccgcagcgtcccgcgcgtccgcagcagcccgaggcgctgccgccggcggcgggtcccggcgacgggcgtacgccgctgtacgacacgctggagaccaactggttccacggtcagcagggccagcagggccagcagcagagcaacggctcggcgcaggccccccagcagcagccgcagtcacctgcggccccccagcgtccggcccccacgccggccgcctcctcctggcgcagcacgccgaacgacgatctcgtcaagcaggccgaacgcgtccgtcagccgtcggcgggcggggtcaccacctccggcctgccgcgtcgggtcccccgcgcgaacctcgtcgcgggtacggctcagcagcaacagcaccaagcaggtccgcaggtctcgcgtgcgcccgatgacgtacgcggccggctgaccaatctccgtcggggcatccagcagggtcgccaggccggtaccggccagaccggcagcttccccagccccactcaccagcaggagcgttagttgagcccgatgagccaggccgcacagaatctgaactggttgatcaccaacttcgtggacaacacccccggggtgtcccacaccgtcgtcgtgtccgccgacggactccttctggccatgtccgaaggcttcccgcgcgaccgcgcagaccagctcgcggccgtcgcgtcggggctcacctcgctcacggccggggcgtcccggatcttcgagggcggcacggtggcccagacggtcgtcgagatggagcgcggtttcctcttcctgatgtccgtctcggacggctcgtcgctcgcggtcctctcccacccggagtgcgacatcggcctcgtcggctacgagatggcactcctggtcgaccgtgcgggtgcggtgctcacgccggacctgcgcgccgaactccagggcagtctgctccactgaccggccccggtccacacaactcacgaaatcaccgtccggccgccacaatccccccaccggcccctgtcagacggcacgactgaccgacttgctgtcccgcccggaggattcatgaccccgcccaccgcctctcatgatccgtacgcacagtcgtacggggacgagggcgaccagccgttggttcgtccgtatgcgatgaccggcggccggacccggccgcgttaccagctcgccatagaggcgctgatcagcacgacggccgacccggcccagctgatggggctgctccccgagcaccagcggatctgccacctgtgccgtgaggtgaagtcggtggcggaggtgtcggcgctcctgtccatgcctctcggtgtggcacggattcttgtcgcggacctcgccgaggccggacttgtcgccatccaccagccgggcggcgacgagaacaacggcggtgcaccggacgtgacactgctcgaaagggtgctcagtggacttcgcaagctctgacggcggggggcggacgaccacctccgccaagatcgtggtggccggcggcttcggcgtgggcaagaccacgttcgtgggcgccgtctccgagatcaacccgctgcgcaccgaggccgtcatgacgtccgcgtccgcgggcatcgacgacctcacccacaccggggacaagaccaccaccacggtggccatggacttcggccgcatcacgctcgaccaggacctgatcctgtacctgttcggcacgcccggccaggaccgcttctggttcatgtgggacgacctggtccgcggcgccatcggcgcggtggtcctggtcgacacccgccgtctcgccgactgcttccccgcggtcgactacttcgagaacagcggtctgccgttcgtcatcgccctcaacggcttcgacgggcaccagccgtacaaccccgaagaggtacgcgaggctctgcagatcggtccggacgcgccgatcatcacgacggacgcccggcaccgcgcggacgcgaagtcggcgctgatcacgctggtcgagcacgcgctcatggcccgtctgcgatagcactcgaagcacacccctgataccacgcaagtcggcgacgccatacggcagttgtcgtagatacgctggagccgactgtgtcctttgacacggtcggctccggcgttcataacgtttcgacagagatctcgggtggtatcaccacgcgtcgcgttcgttcggtctcgctgcgctcacaaaagccccgccttttggcggggctcgctctttatgaccgttttatcaggggcctccagcgagcggaatcctcccttccgagtgtttggaagagcgccgcttgacgtgctggaatgcctgaactgcccattagtcaaagacgtactcagtcaacgacgtactgggctctggagacaccgcggcacaacgttggtgccgacgccgagaggttgttggtcgagtgaggcgaagcaagaacggtcccgagccgtcggcacggggcaacttcaccccgccgccgcggggaggggtacccgcacaatccggccccgagccggcggcggtggtcgcgcccagcggcagccgtctctctccgcgcaactggcgcgtgccgaccaggctgaacgcgatcctgctcatacccgtgctggtcggcctggtcatgggcggcttccaggtgaagggctcgatcgacacctggcaggaagcccgcgacgccgagaaggtcgcgaagatcgtggcgtccgccggtgaatacgccgaggcgctgctcaacgagcgcgatgtgtccgccgccccgctcctcaagggcgaccggaacaacgcgacggtcaagaaggcccgcgccctcaccgaccagaaggccgacgccttccaccaggaagtcgtcggaatgccggccaaggcaggtctccagcgccggctgggcctggtggagaaggccgaaccgcagctggagcagatccgcaaggcggcctacacgaccgccatggacccggtgaagaccgaagagggttacgtcaccgtcgagcacctgctcatggagttctccaacgagctgggcctgggtaccggcaacatcaccagctacggccgtaccgtgtacgccatcgcgctggccaagggcgccgagtcgctggaacgctccatcggcctgcacctgctgatcaagcccagcagcgacgagaagatccgcgcccagcagatcacctccttcacctcgtacgcgtacctcgagcagatcgctcttcaggagtacgtctccggcggcaccgagcaggactacgcccggctcacccaggtgatgaagcagaagaccgctgcgggcaaggccaagctcgccgaggccaagagcaggaccgaggccgcgggcggcaccttcgtggccccgccggccctggacaagatgatccaggcgatcggcagtggcgccacgcccgccgccctcgcccagcagggcatcacccccacgacgtggatgtccgccgcgaccctcaagttcgacggctacagccaggtggagaaggaactcgtcgaccgggccgtcaacgacgccaacgacatcgcctccagcgcccagcgcgacgcctacatcaacggcgccatcgtcgtcgtggccctgctcgccgcgttcatcctcgccggcctcatggcccgccagatgagccgctcgatgcgccagctgcgcaacgcggccttcaatgtcgccgagcagcgcctgccgatgctggtcgaccagctgtcccgtacggacccgggacgcgtcgacacccgcgtacaggccatcccgatcaccaccacggacgagatcggcgaagtcgcccgcgccttcgaccaggtccaccgcgaggccgtacgactggccgccgagcaggccctcctgcgaggcaacatcaacgcgatcttcaccaacctctcgcgccgcaaccagtcgctgatcgagggccagctgaccctgatcaccgacctggagaacaacgaggccgacccggaccagctggagaacctcttccggctggaccacctcgcgacccgtatgcgccgcaacggcgagaacctcctggtcctcgccggcgaggagcccggacgccgctgggaccagccggtcccgctggtcgacgtgctgcgcgccgcctcctccgaggtggagcagtacgagcgcgtcgagctgtccggcgtcccggaggccgagatccacggccgcgccgtgaccgacctcgtgcacctgctcgccgagctcctggagaacgccaccacgttctcctcgccgcagaccaaggtccgcgtcaccgcgacccgtctcccggacggccgcatcatggtcgagatccacgacaagggcatcggcctcaccgccgaggacttcgcggacatcaaccacaagctggccaacccgccgaccgtggacgccgcgatctcccagcgcatgggtctgttcgtggtcggccgcctgtccgaccggcacggcatccgcgtccagctgcgcccctcgggcgagcaggccggcacgacctcgctggtcatgctccccgacgtcatcacccacggtggcggtggcgagcagcaggtgcagcgcgacgagttcacggtctcgcagatcatcccggagcagcagaacttcgcgggaggcggcgaagccttccaggtggagccgatgcgtacggccgcggagctgggcttcgacgacagccgctacaccgaggtccccgacgacatacgggagctggaccccgtcggccgctcgctgatgcgcgaggagcgccgggcggccctggaggcccaggcacacggcccgcaggacggttccgaggggcagcgctaccaggacgagttcgacgcgtcgcagcagccggcctacggcaacgggcagaacgggtacccggagcagcaggcggggtacgaccagcagacggcgtacgaggagcagcagcagcctgcgtacgaggagccgtacttcgcgccgaacggcgacttctcccagaccggggagttcccggccaccggagagttcgcgccgaacggtgacttcgcctccaacggcggctatccggaaccctcgtacgcggagccgaaccaggagagcaactcgggtggcgggcgcaccgcctcggagacgttctcggccttcgacgagccgtcctaccaggatgactggccgaagcaggacgactaccagagcgggtaccggtccgagtacgctccggaagcggaatcctcgcaggccgctgacgtgagtgagcgggaccacgtaggcttcacccgtccgggaccggccccctccgccgcccacgcactgaccgacgccggtctgccccgccgcggatccaccgggaacggcaacggcaacggcccgcagcgcgtgagcccggacccgtcggcggcccctgccgggaccgagacgggcggcatgggcagcaactggcgctcctcgaacgacgagcgctggcagcaggcctcgcagctgaagaagcccaaggccggcggagttacctcctccggactgccgcgacgggtacccaaggccaacctggtcgagggaaccgcggattcgaccccccagggcggcccccaggtctcccgcgctcccgaggacgtccggggcaggctgagcaacctgcgccggggcgtggagcggggacgcaatgcaggtagtgacacgaacggccagggcctcggtcctgatagcacctacaaccaggagcgttagtgtgagcccgatgagccaggcggcgcagaacctgaactggttgatcaccaacttcgtggacaacacccctggggtgtcccacaccgtggtggtctccgccgacggactccttctggcgatgtccgaaggctttccccgtgaccgcgccgaccagctcgcggccgtcgcgtccggtctgacctcgttgaccgcgggtgcctcccgcatcttcgagggtggcgctgtgaatcagacggttgtggagatggagcggggattcctcttcctcatgtccatttccgatggttcgtcgctcgcggtcctcgcacacccggaggcggacattggcctcgttgggtacgagatggcccttctggtggaccgtgccggtacggttctgaccccggaccttcgggcggagctccagggcagccttctcaactagcagacagacggtacgttttggcgtcccggggccttaaggtttcgggacgcggcttccacgtgatgggtgcccggtgcagttggaggaggagagagagtggcaacacccccaggcggttcgtcttcgggcaactggtcctacggccccggccagggccagggtcagggtgagcagaaccggtacaacttcccctccgcacccagcccgcggcgtcagccgtacgcaccccagggcccccagggtcccggtccctcgccgtacgaccagccgtcggcgccgcgcatccagcccgtgcagccacagcgacgctcccccgagccggcgcccgcagggtcgtcgagcaaccccctggtgcgcccgtacgccatgacgggcggccgcaccaggccgcggtaccagctcgccatcgaggcgctggtgcacaccactgcgcagccgcaccagatgcaggggcaactgcccgagcatcagcggatctgcaacctctgccgagagatcaagtcggtcgccgaagtctcggcgctgctcacgatccccctcggcgtggccaggatcctcgtcgccgacttggcggaggcgggcctggtcgccatccatcagcccggcggcgacgaaaacgccggtggccagccagacgtgactttgctcgaaagggtgctcagtggacttcgcaagctctagcggagggccttcccgctccaccacgtccgcgaaaatcgtggtggcaggcggcttcggcgtgggcaagaccacgttcgtcggtgccgtctcggagatcaatccgctgcgcaccgaggccgtcatgacgtccgcgtccgcgggcatcgacgacctcacccacaccggggacaaaaccaccaccacggtggccatggacttcggccgcatcaccctggaccaggacctgatcctgtacctgttcggcacgcccggccaggaccgcttctggttcatgtgggacgacctggtccgcggcgccatcggcgcgatcgtcctggtcgacacccgccgtctcgccgactgcttccccgcggtcgactacttcgagaacagcggtcttcccttcgtgatcgccctcaacggcttcgacggcaaccagccgtacaacccggacgaggtgcgcgaggcgctccagatcggccccgacaccccgatcatcacgacggacgcccgccaccgcgcggacgcgaagtcggcgctgatcacgctggtcgagcacgcactcatggcgcgactccgctagcgcatccgcgcgcggtagcagcagaagggggcgccctctccggtcggagagggcgcccccttctgtcggtccggtgtgccggtccgctctgtcggtccgctctgtcggtccgctctgtcggtccgctctgtcggtccgctctgtcggtccgctctgtcggtgaccgctctgtcggtccgctctgtcggtccacggcaacgggacgtgagccgacaccgcccgggtcccccgcgccggaaaaccgcggtcgggggcggcagcggcagcgggacgtacgacagcggcgcccgacccccgccgccagagccaccgccgtcggggccaccgccaccagggcacagccgtcggggcacaagcagaggggcccctcacccaagtgggtgaggggcccctctggcctacggctgagcggcgcggcctagccgtgccagctgtgcggtgcccggaaacccggctcgcgctccaggcggcgccagcccgccttcgggcggccacggcgggccggcgaggcggcgggggcggttgccgcgcgagccaggaggatggccgtgatggcggccacttcctcgggctcggcgtggcccttctcgacgcgaatgtcaggcgggttcatgggcttcagtctccgtggatgaggtttccgcgggggtaccgcggaggatccgcagggttactgcggcgggttgccgtgcttgcgggagggcagatccgcgtgcttggtgtgcagcatcgcgagggacttgatgagcacctcgcgggtctccgccggatcgatgacgtcgtcgaccaggccgcgctccgcggcgtagtacgggtgcatcagctcggccttgtactccttgaccatgcgggtccgcatggcctccggatcctcggcctcggcgatctgacggcggaagatcacgttcgcggcgccttccgcgcccatcacggcaatctcgttggtcggccacgcgtaggtgagatcggcaccgatggactggctgtccatgacgatgtacgcgcctccgtacgccttgcgcaggatcagcgaaatccgcggcacggtcgcgttgcagtacgcgtagagcagcttcgctccgtgccggatgattccgccgtgttcctggtcgactccggggaggaaccccgggacgtccaggagggtcacgatcgggatgttaaaagcgtcacacatctggacaaagcgcgcagctttttcgctcgcctcgatgtccaggaccccggccagggtctgcggctggttggcgacgatgcccaccacacggccgtcgagacgggccagtgcgcagataatattgcgggcccagcgctcgtggatctcgaggaagtccccgtcgtccaccagctcctcgatgaccttggccatgtcgtacggccggttgccgtccgccgggaccaggtccagcaggacgtccgagcgccggtcggccgcgtcgctcgactcggcgtgcggcgggttctcccggttgttctgcggaagcatcgacagcaggtagcgcacctcagcgaggcacgtctcctcgtcgtcgtaggcgaagtgacagacgccgctcgtctcggcgtgcacatcggcgccgccgaggccgttctgggtgatctcctcgcccgtcaccgccttgaccacgtccggcccggtgatgaacatctgcgaggtctcgcggaccatgaacacgaagtccgtcagggcgggcgagtacgccgcgccgcccgcgcacgggcccagcatcacgctgatctgcgggatcacgcccgacgccttggtgttgcgctggaagatgccgccatagcccgcgagagcgctgacaccctcctggatgcgggcgcccgcaccgtcgttcagggagaccagcggggccccggccgcgatggccatgtccatgatcttgtggatcttcgtggcgtgggcctcgccgagagcgccgccgaagatgcggaagtcgtgcgcgtagacgaagaccgtgcggccctcgaccgtgccccaaccggtgatcacaccgtccgtgtacggcttcttggcctccaggccgaacccggtcgcccggtgccggcgcagctgctcgacctcctggaaggaccccgggtcgagcagcagctcgatgcgctcccgggcggtcagcttgcccttggcgtgctgcgcgtcggtcgccttctcgctggggccggccagcgcctgcgcgcggatctcgtgcagttcggccacgcgcccgcgcgcgtccgtcggctcacccgacgtctcacccggcgtctcgtccaaaacggtcatgtagcgaccttacgaagcccacgaagaaaagcgagccgtcgactccgtacagtctccggcccgttttcctggtgcccctgaacagaaccccacgcgcatgcagccgatctgactgctcagaggggttgttgcttgtaggagcccaacaaagtcctcagctgagagtcacctcacatttgtgcgtggcacatgccatccctggagtgacacggaccctcagtcggcggccggcggcgacgatgtcgacggccggatccgcgcggacgacccgccctacgggatgatcccagacgatctccaggggctgtcccgtgcgcgacggctcgctcacgcagagcgtagcggtccggccccggcggcggacgagcacgctcgcggccgccgaggcggccagcgggcccgccgtgccggccgaccagaagttggccgccgtgagggccagggagccgacgtggacggcctgccggcgggcgtcgttggcgaggaccgacagccggtggcggtcggccgcgtgggcggcgacctgcgcgcggctcgcgccgggcagcaggacgtaggcgtacgtcgcgtccacggggtccgtgccgtggtccagccacagcgtctgccagcgccgggtgcgacgctcggtcgtactcgtggtgttgatgtcggaccaggcgccggtgcggtcctcgcggagggcgcgcagctcgccgccggcgggcagcacccagccgccgtggccctccaggtgcgcccagccgtgcccccggacgaaggcctgcgtgccgccctctcccagattgcggttgtccaccaccgtctcgaccggtacgccgtccctacaggtgatccccgcgcccagacagatcacggagtccgccacacagaaccacgacttgcgggcctccagcgtcgatccgagccccttcacctgctggccgaccgccgcgtacacgccgtccgtcacgccgccgacccaccgcacggccggtttcggctcaccccactcgccgcccgcccggtcggcgagccgcttggtggacacggtcgttccgggcagccggtaccagtcgacggtgggccagtaccagtccgtgtactggtcggtccggccgctccaccagaggagcattccggcgccggtgtgccagccgcgggggttctcgccgttgccgcattcgtacgaggcgatccgttcggaggacatggagatgttcgcggcgaagccccggccccggtggacggcgcggtccatgtgggcgaagaggtggtgcccggcgggctcgggagcggcacggacgccggagtccgcgacggcgtgcagccgggccaggtccgcgaccccgaactggggtgcggtcaggatcggcgtgacgtcgtcccgttcgatccaccctttgatccgagcgtgccaccgtgcgcgctcctgagggcccgcgccgcccgcgagcagcgcgatcgcggcgatcagcgcctgcccgtggaagtggtcgccgcgcatgacgtgcaggtcgtcgctcttgaggtaaccgcggctgatggcccgcccgttgacgctgtccatgaccaggccgtcatggatgaggggcgcgtaggcctgctcgacgctgtcgaggatgatctgccggttcggatcggtgacgtcccaggtggaaccggcgaaaaggctgaacagccggcccagcccgtcgagcaacacctgtccgtacgttcccgagtaggcgacccaggtgtgctggacgaacgagccgtccgcgtagagcccgtcgccctgggtgacgtacgggaagacgggcgagagggcgtcgcgggcgagggcgatcctgtcgggggcccggcccaggatgccgctgagggcgacgccgcggcagaggtcgacgcggttggcgccggtggaggtgccggagtagtcgcggagcatgtcgtcggggatgaagtggccgacggcggcgcaggcggcggctcgccgcgcggccgagagccgatcgtgcagggcggcgacgatgtccatgaggaggcgggggctgccgatctgccactcccaccagttgccgtagcgggtggtggtcgggttgtagacggtcgcgctcacgtggtcgaggccccggacgatgtccgcgagcaggcccgcgtcgccggtcgagccggtgccttcctggacgtaggcctgggtcatcgtccagagccggctgtagctctgggtgatgccggagggcgggtcgaaggggtggccgggccagagggaggcggcggccggggccatggtggcgcggtagccgcgggccagttccccggtgcggcgcaggcgggaggcgtagggctcggcggtggggtcgtatccggcgccgagggcgaggacgagccaacggcgccggagggtgtcgtactcgtcgtcggcgtacgcggacggggcgccggtggcggtgaccgtggccgtgatgccggccgccaggaccgctgcgcggaggaacgtacggcggttgggagtcatgtgcatgccgtgtaccaccccggcggccggagcggaaccaggcgccccgtacgcgtactgcgagtggcgggggtcagcagccgccgcagttgtagtagaggacgtcccagtggttgccctcgtcggcgtagatgttgccggagccggaccggtactgcggggctccgtccccgcgcaggccgatgtaggtgaaggtgttcttgatgtaggtggtgacgcaggtgctcttgccgtagtcgagcttgtagccgttccagtgcgagtacgtgccgctcgcgtggccggtctccgtgccgccggtgatgttgagcgcgcacccggtggcctgcttgagggtctgggcgccctgcgcggtggcgaggttgagctgctcgaaggacgtacagctggggttgttgcggtcggagcagccgccggaggaggaccaggtgatgcctgccccgcggaacatcgaggtggcggtggcgtggctgatcttggtgacggcgaaggcgtcggtggcggtaccgacgacggcgacgcccggggcgacgacgagggcgagggcggtcagggcggagcggaatttcctgcggaactgcatggggaacccttcctgcggacggccgtgcttgccgacttttctgtggggcggctgtgcaggtggcgcagggagatggtgcccgacctctacgcgcgtccgccagagggcggggccgacgagcgcggcgtaacgtcgtgaacgcgcagcggattaagttgaaacccgtacggaataggtctaccgtctcccctgttgacctcgttgaacgttaaacagtctctccccaaggagcacgtcatgggtatcttcggccgcaagaacacgaccgacacgaccagcacgaccgcgaccgcccccacggccgccgtgagcccggagctggccgcgctgaccggcacctacacgatcgacccggcgcacacgacgatcggcttcgtcgcccggcacgcgatggtcacgaacgtcaagggcggcttccaggagttcgagggcaccctgcacctggacggcggggacccggccaagtccagcgccgtgatcgaggtcaggatggacagcatcgacaccggctcgtcggaccgcgacacccacctcaagagctcggacttcttcaagacggacgagttcccgacgatgaccttccgctccaccaaggcggaggcgctgggcggtgacgactaccggatcaccggtgacctgtcgctcctcggcgtcaccaagccgctcagcatcgacctggagttcaacggcgcggccagggacccgttcggcaacgagcgcgtcggcttcgagggcaagacggagatcctgcgttcggagtggggcctcacgtggaacgcggcgctggagacgggcggggtgctggtgtcggacaagatcaagctggtgttcgacatctcggcgatcaagcaggcgtgacgtccggccccgtccgccgctccatggcgcccggtgtcacggcaggactccggaagcccacggtccaacggggcggcggcggcctcggcgtcatcgatgtcggcggcggtcagaagcccccgccgaagtccccgccgcccccgaagtccccgccaccgcccccgccgtcaccgaagcctccgccgaagtcgctcgcgtcgaagtccgcacccgagacgtcgccgcccgcgtagccgccggagccgaagtcgccgtacccggagccgtagtcggacgcgtacgacggactggacatcatgccgccgagcagcgtgccgaccagcagccccggcaggagtccgccgccgaagtagccgcccgcccaggggccgtaggccgggcccgcgtcccagtacgggcggcggccgtactccgtgtcgacctcgcggacggccggggcgagtccgtcggacaggcgcgcccggtccgccgcgcagaccgggacctcgcggggcgcgccgcccgcgggcgtccacgtcgcgtcggtgaccgacgggccgtgccgcgggtcgaagaagcagggcgcgcggcgctccggcagcgggcggccctcccggcgggcggcgagctgcgcgagcgagaaacggccgtcctccagcgcctcggtgacggcgcgtacgtcctccgggcgctcagccgccgccatggacgacttcgcccgctcgtacgcgtccagcgcacgctcgtagtccgcgcgcatcgcgtcgtccgcgcccgcctcggccgggtggaagtccaggcggtccagctcctcaccgaaggccgtgatgtcctcgtcgaccaccacgcgcagcttgtccagcgccgcccgctgttcctcctccttgcggcggcggttgcgccggaccagcgtgtacgcgccggccccaccggccaccaggaccgcgccgaccccgatcagggaggtcgacgacaccccgccgccgcccgaggagtcccagctcgacggtgccgagccgcccatgttcctgagcgcgcggtccgtgaagtcgttcagctgggtcttggtgtcctcgccctgcacgctcttgaccaggttctgcacagcggagcgggacagcaccgcggagtcggcccgcgcgtcgaaccggtcgcccaggcggatcgcgtacaggcccgtgacgccggtgtccgtacggagatcggtgaagagattccgcgtcgggaagccggccggcaggacggccacgaagaccggcttgtcggcgtcctcgatcttcttggcgagggcgtccgcgtccgccgcggacagctgcgcggacgccgccgggtccacgtacaccgggctctcgcgaagggcctcggccacggccgacacgctcgtggccgcatgccccgggggcgccccggtggacagcaccgccagagcggccgccaccagcgcgatcagcgacaggaagagcccgcggagccggactcctgggagtagcacggccttcataccatcgaacctacccgaaggtaggcaaaactggacatcgaacctggtgggcgggtgcaggccgcgcgggtgcaccgaccaccgggggctgagggccgaggtgcgtcaggcggcccggtaggcctccgtcagcttcgcgaccgccgccccgtacttcccggtcagcagcagatggtccgcgtcggcgaacggccccgcgaccgccgcggtgatccccggtcccgatccggccttctgctggacgagcagccgcgccttgccgaccagagcgcgtccggccttgccggaaccggtcctctcggccaccgccgccgcgaccgccagtgccttcagcgtcgccgcaccgccggccggcaccttcgtcagcgtggtcagaccccagccgtacgggaactgcggatcgtacgtcgtgtcaccgacgttgatcggcagctgggcctccgacttcggccaggtgaccgggagttgaccggtgaacgcccgcttgccgtacagcacgtcggcgacgccgtcgccctccgtgcccggcagccaggacgcgacgagcgcgtcgatgtcgccgagccggtcgccgatcagctggggccgtccggagacgatcagcaccgcgcacttcatggcgccgcacaccttgtccacggcggccttgtccgcggcggtcagctccaggtcgttgccgttgccgacgtcgccgacgccctcggcgtacggggtctcgccgacgacgaccacgccgacgtcgtagccgctggtgggcgccgacgcgtccttcgagtaggtgacggcgcccccggaacccgcggccttgcgcattccgtccaggatcgtcgtgccgtcggtgtgcttccctgaggagccctgccaggtgatcgtccagccgccggtctggttgccgaggtcgtcggcgttcgaaccggcgacgtagaccttctgcgacttcttcagcggcagcaccccgcccgcgttcttcagcagcacctgcgactcggcggccgcctcacgggccacggcgcggtgcgcggacgagccgatccgcgacgcgccgctcgtgtccgcgtacggcttctcgaagaggccgagcttgaacttctgggtgaggatgcgggatacggcgtcgtccacccgcttctgactgacgcggccggccttcacctcgtcgatcagcgtcgtacggaagtccttgtactcgtacgggaccatgatcatgtcgaggcccgcgttgatggacgtacggacgtcggacgcgtagtcgccggggatctggtcgatggccttccagtcgctgatgacgaagccgtcgaagcccatgcggtccttcagcaccccgttgatcatgtccgcgcgggcgtgcatcttcaccgcgccctggccgtcgccgaggatgtcgagcgacgagtacgagggcatgaccgagccgataccgcggtccacggcggtctggtacggcgcgagctgcaccgcctccagctcctgccgggtgaccttggtgacgccctggtcgatggtgtacgtgcccgtcgtggacgagccgtacgcggtgccgccgtcgccgacgaagtgcttggcggtggccagcaccttgtcgtcgtccttcaggtccttgccgtcacgggcaccctggaggccctggatgaccgtctccatggacttgacgagggccgggtcctcgccgaaggactcgtacgagcggccccagcgctcgtcgcgcgtcacgcacaggcaaggggcgaagtcccatgggatgccggtggcgcggacctcggcggcggtcaccgcgccggtccgccgggcgatcccaggatccctggacgccccgatgccgatgttgtgcggcatgatcgtcgcgccggtgaggttgttgtggccgtgcacggcgtccacgccgtagatcagcgggatctggaaccgtgtcgcctgcgcccggagctggaaggcgtcgatcatcttcgcccacgcctcgggggtgttgggcgtcggggtcgagccgccgccggacaggagtgagccgaggtcgtacgccgcgatgtcgccctgcgcggtgagcgcgccgcgttcggcctgggtcatctgcccggccttctcctccagggacatgcgcgagacgaggtcggcgacccgcttcttcaccggcagcttcgggtccagatacggcagcccgtgcgcgtcgatgacgacctgcggggtctcggcgggggccttcgcgccggtgaccgtgagcttcagggggatcgtctcggcgggttctgcggacctgtccttgagcgtgggcacctggatcgtgcgcgaggtgccggacgccgtgcccgccgggaaggtgaccgagcccttgaccggggtgtagtccttgccggattccgcggtaccgcccgtcgcctcgtacgcgacggtcaccggctcgtcgatcggggcggaaccggtggtggcgacggagacccgcacgtcggccgtgcggccctccttcaccgggtgaacggcggagtcggtgaccacggaggcccgcagcgactgatcgcccctgccgtacaactcgacgccgtccatggcgaactggcccttgacgccggccggaagcgtgacggcgtacccccacatcccggtgaggccgaggacctggtcgatgccgccgacgggctggtagtccgtacggtaagtgaagtcggtgaacgggatctcgatctgcttccagccggtgaagtcgtcggtgaaggacgtcgtccacagctcggaggcctcgccgttggcgccgccgtccttgatctcgaaggcgaccttcttgccgttgccccggccgtcccaccagaagcggatgccctggtgcgcggaccagtcgtgggcgggccggtcgaaggcgaagtcgtgggtgaagccgccgtagccgctgatgtcgtacgtgccggtgaggactttgtcgccctcgggcgcgtcggcgcgggcggtcagggcgagctggggcgggtcgtcggtgtcgccgccccaggtgaagatgccctcggcgggcggactggcgaaggggacttcgccctcgaactggtcgacggggacgggcgccgggtcgtccgcgccgacggcggccgcggctccggcaaggggcagcagcccggtgagcatggcggccgagacgagcagggcggttcttcgcatggaccttccctcgactctcttcgtgctcttacgacttagatcacggcgtgagttaactggtgccccgtgcggccgtcaagacttcacgtcagaacaggtacacacccgatctccggctggatcagggctgttgtgctttcagcccttgaacacgcaaccccttgacgcgcgtccgcggccgtcatttactcacgcctcgcacgccccactcccccaccccagaagggcgacgcgccatgaggagatccactcgggcggcccggcttctgctcgccgggctgctcagcaccgccgggctgaccgccgtctcgaccgcgcccgcgcacgccgcgggcgaacaggtcaccgcctggctgaccacgacggacgacaccggcggacgccatgtcgtgcgcgggctccaggcccagacgccgttcgccttccagtccggcagcggcggcagcggcgagaacatcaccgtggacgagaacacccggtaccagacattcaccggtggcggcgcgtccttcacggacaccgcggcctggctgatgaacagcagcggggcgctgtccgcgacgacccggaacgcggccatgaccaagttgttctcgccgacggacgggatcgggctgtcgttcctgcgcaatccgatgggcgcctccgacctggcgcggtacgggtactcgtacgacgacgtgccggccgggcagaccgaccccaacctgacgagcttctccatcgcgcacgacctcgccgacgtggtgccgctcaccaagcaggcgctccagctcaacccctctctgacggtcatggcctcgccatggacggcgccggcctggatgaaggacagcggctcgctcaacgggggctggctgaagtcggaggactacggggcgtacgccaactacttcgtgaagtaccttcaggcgtacaaggcgcagggcgtcaacgtctcgtacgtgaccgcgcagaacgagccgacgtgctgctcgggttacccgtcgatgagctggaacgccagcgggctcgcgtacttcaccaagagcgagctgctgccgaagctccaggcggcgggcctgacgaccaaggtcctcgcgcacgactggaactgggacgtctacgactcctacgcggcctcgacggtcgacgacgcggcggtgcgttcgcaccccaacttcggcgggatcgcctggcacggctacggcggtgacatcgccaagcagacgtccgtgcacaaccagtacccgaccctcgacgccttcggcaccgagcactccggcggcacctggatcgccaaccagcagcgcgaggacatgtccaacatcatcgactacacccggaactgggcgaagtcggtgaccaagtggtcgctcgccgtggaccagaacatgggcccgcacaacggaggttgcggcacctgcacgggtctggtcaccgtgcacaacggggacggcgcgagcgggaccgtcgactacacggtcgagtactacacgatgggtcacctgacgaagttcgtccgcccgggtgcgcagcgcgtcgcgtcgacggcgagtgcgtcggtgccgaacgtggcgtggcgcaatccggacggttcgaaggcgctgatcgcgtacaacgacgcgtcgacggcgaagacggtcaccctcaactggggctcgcagcacgcgacgtactcgctgcccggcaagacgtcggcgacgttcacctggtcggggacccagtcgggcggcggcgaccagacgggctcgttcgtggggctcgcgggcaagtgcctggatgtggcgagcagttcgtccgcgaacgggacggcggtgcagctgtacgactgcaacggctcgaccgcccagcgctggacggtgaaggccgacggttccgtgcaggccctcggcaagtgcctggacgtcacctcggcctcgacggccgacggcgcgaagatccagctgtacgactgcaacggcacggcggcccagcgatggtcgtacaacgcttcgacgggtgatgtggtcaacacggccgccgacaagtgcctcgacgtgaccggcaactcctcggccaacggcgcccgcgcgcagatctggtcctgcacgggcgccgccaaccagaagtggaagctccagtgagtccggactactcggccggctccacgccggcccgcagcaggccgtacgtgtaggcgtcctccagggcctgccaggacgcggcgatcacgttctccgcgacaccgaccgtcgaccattcaccggtgccgtcggaggtggagatgagcacgcgggtcgtggaggacgtgccgtgcttgccctccaggatgcggaccttgtagtccaccagctccagcttggcgagctgggggtagatcatttcgagggcgacgcgcagggcccggtcgagggcgttgaccgggccgttgccctcggcggtggcgacgatccgctcgcccttggcgaagagcttgaccgtggcctcgttggcgtgggtgccgtccgggcggtcctcgacgatcgcccgccaggactcgacctcgaagtacgtgcgggccttgccctccgcctccgcgcgcagcaggagttcgaagctcgcgtccgccgcctcgtacgtgtagcccttgagctcgcgctccttcacccgctccacgacccggccgaccagctcgcggtcgccgctgatgtcgacgccgagctccttgcccttgagctcgatggaggcgcggcccgccatgtcggacaccagcatccgcatggtgttgccgacccgctcggggtcgatgtgctggtacaggtccgggtcgaccttgatcgcggaggcgtgcaggcccgccttgtgcgcgaaggccgagacaccgacgtacggctggtgcgtggagggggtgaggttcacgacctcggcgatcgcgtgcgagatcctcgtcatctcgcgcagcgcgccttcggggagcaccttcttgccgtacttcagctccagggccgccaccaccgggaacaggttggagttgccgacccgctcgccgtacccgttcgccgtgcactgcacatgggtcgcgcccgcgtccaccgcggccagcgtgttcgccaccgcgcagcccgtgtcgtcctgggcgtggatgccgagccgggcaccggtgtccgcgaggaccgtggcgacgaccgcctggacctgggcggggagcatgccgccgttggtgtcgcagagcacgaccacatcggcgccggcctcggccgcggcccgtacgaccgccttcgcgtactccgggttcgcccggtaaccgtcgaagaagtgctcacagtcgacgaagacccggcgcccctgggagcacaggtacgagaccgtgtcgcggaccatctccaggttctcgtcgagcgtcgtgcgcagagccagttcgacatggcggtcgtgcgacttggcgaccagggtgatcacctgggcgcccgcctccagcagcgccttgacctgcgggtcctcgctcgccttggcgcccgcgcggcgcgtggctccgaaggccaccagctgggcgtgcttgaagtcgatctcctgctgggcgcgggcgaagaactcggtgtcccgcgggttggcgccgggccagccgccctcgatgaagcccacgccgaagtcgtccaggtgccgtgcgatggccagcttgtcggcgaccgtgaggttaatgccctcgcgctgtgcgccgtcgcgcagggtcgtgtcgaagacgtggaacgaatcgtcgagttcgctggtttccgtcatggtctctggctcctgatgttggatctcggtctaccggaatgaccggttccaccgtcccccgatggcaatgatccctcgcgctcccttcccggcatgaggtggggccgggaaaaagaaaaacccctcgcgggtgcgagaggtctgcgcgcgggtcgaggacgacggtgtccgcccgtacgtagtggtacgtggcggtcactgcggaccggcgcgcctgctgccaataatcatggcgaacgagagcacgggggcagtctggcacagaccgcccccgcgctcaccggtgtctcaggatgcgagccgggccgtccgctcgtgcgaagacttccggccgtcgccgacacggtggagatccacgtcccgggtctcccgcatggtgacgtacaccacgagggagacggcggcacaggccgccacgtaccagtagaagccggactcgatcccgccgtccttgaaccacagggcgacgtactccgccgtcccgccgaagagggagttcgcgagggcgtagggcagggcgacgcccagggcacggacgccggtggggaacagctccgccttgaccaccgcgctcagcgccgtgtacggcgtgatcatgaccagtgcgaagagcgcgagcccgaaggccggccagaagctgtccaccttcgacaggagggtcatcaccgggaccgtcaggaaggtcgcgcagacaccgaaggtgatcagcatcgggcggcggccgatccggtcggagagggctccggccagcggctggacgcaggcgaagaccagcagcgcgcagaaggagaccagggtggccgtctgcttgggcaggcccgccgtgttcgagaggtacttcgtgagatacgtcgtgtacgtgtagtaggcgagcgtgccgcccatggtgagtgcgacgacgaggaacgcctcacggcgatgctcccacagggcgcgcagcgagcccttctcgccgaccgcggcgtcgccgtcggccgactcctcgtacacctcgctctccagcatggtgcgccgcaggtagaagacgactgccgcgcccgccgcgccgacgacgaacgggatccgccagccccagccggccagcgcgtcctcggacagggtgcgctggaggatgatcagcagggcgaggccgatcagctgaccgaccgtcatcgacacgtactggaagctggaggcgaatccgcgcttcttcgggtcggtcgcctcggtcatgtaggtggcgctggccgcgtactcaccgcccaccgagagcccttgcagcaggcgagcgaggagcagcacgaacgcgccgccgtagcccgcgacggcgtacgtcggcgcgatcgcgatgaggaccgcggacgccgacatcagcgtgaccgtcagggtcagcgcggtcttgcggcccctgcggtcggcgactctgcccagcagccagccgccgaccgggcgcatgaagaagccgaccgcgaagatgccggcggtgttcatgagctgggccgtggggttcccgtcagggaagaaggcccccgcgaaatacgtggcgaagctggcgtacacgaaccagtcgaaccactccaccatgttgccggccgagccgacccagatcgtcttccagtgctctcgtcccatgagtgccatgagcggtaacgtgcccgctgatcacggccgcgacaagagcgcctcgggtttcgttcattgcgttcacgcctcgggggaacccagtcggcgcaggaacacgtccaccgtgccgttggtgtcgcccgggacgaggtcgggcgaggcggagtcgaaggcgaccgctgtgccgtccgggttgacggacgggttgccggccgcccggtcgttgcggtgtcctcgggtgtcgacgctgatcaaccgcgttctgccggtggccaggtcgcgcaggtacacggccggcacgccgcgggagccgcggattccggccgagacgtacgcgaggtgcagcccgtcgccgctcagcgcggcctcggcggtgtaggcgtgccggcccgcgcccttgaccaggcgggtggtgcccgcgtcgaggtcgcggacgaagacgttcacggtgccgttggtgtcgccgggggcgaggttcgaggcgtaggagtcgaacgcgacgtgccgtccgtcggcgctcagcgacgggccggtggaggcgcggtcggccgggcggccgtgccgtcccacggacgccttctccagggtgccggtctccaggtcgcgcacatagatgtcgctgtcgttggccgggccgcccggatgcgggatcgacgactggtaggcgacataccggccgtccgcgctgatcgacggacgcaccgccgcccgggatccgtccgccgagtccgggctgacctgctcgatcgtgccgtcgtagatgcggtagcggtagacgcgcggctgctccacgtggtccggcgtggccggcagggtggcgctgaaggccatccactggcagtcggcgctcatcgcgggctgccccgcccaggtgaaggggacgccctggtagccgtgactggcgtacgagagcttgccgacaggggtgttgcgcacgtagaccgagggcgtggtgccgccggccggcgtgcggtcggagacgaaggcgatcatccgggcggtgtggcaggccgaggggtcgtacgagcgggcggcccccatgttgtagctgacgcgttcgctgttgcggtaggcgtcggacacgccgttgtggtcggtgctccagacgggtccgtcgctggtgtacacgacgccgcccttggaggtcagctgcgggcggtacgaggggtcgtcgatctgggcgccgtcgagggtgacgctgacgcgttccgtcgtgggcaccgggtcgtcggcggccgccgggtacgcggcgagagccgtgagacagacggcgaacaggagcgcgggggcggttctcgtgcgcgggtgcatgctttctcctccggtcggcgggtgcggcgtacgaagcgctgtcagcgcggtggtcggtgttgccggcatgtcggtgttgccgggcaccaggccgtcggacgtcgaaccgatcacggccgcccgcccgtcggtcggcgctcacggcgccggcggggccgtcgagcccgccggggccgccagggccgtcggcagcggcagcccgtcggccccgccgaacggcgggtgacgggcggcgggtggcgggtggcggtgcggatgtgcaggagggcagggccccccggggtccactgccgcggccggtgcgtcggcgacgcggcgcgggcggccggcgcttcaggtcacgtagacgctcaggtcgcgtgaatacgcgccgcccttggcgtcgaggacgccctcagggcgtttgctggagacacgcgcggccatggacatggtttccccccggaaccttgtctttccccccggccccgcaccgagggctcaccgggatgcaaccgcatcacccaccccgggtcaatgcgctcgtttacgtacaacccggacgggtgatcaggtgtccgcgagacccggtcgccccagcgactcatcgaggaactcccgtacgtggccgagaatctgcccccggtccgtgccgcggaggccgatcgccacgtggatggagaagccgtcgagcagcgcgcgcacccgggccgcgaggcggtccgggtccacggggcggaactctccccgggagaccccctccgcgagcagtgccaccaggtcgcggtgccaggcgccctcgatggccgcctgtcgctcgcggccctgctcgtcggcgttctgcgagtggttccagacctccagccagagcgtccagtgcgggtcgcgatggccgtcgggcacatacaggtcgacatacgcgtccagccgttcgcgggccggggccgtccgcgtgaggagccgcccgcgctcgatgccgaggcggccctcgctccactccagggtctggagcagcagctcgtccttggagtggaagtagtagaggagatggccgctgctcatgccgacctcgcggccgagcgccgccatggtgagcttctccagaccgcgctcggcgatcatgtccatggcggcggcgaggacctcctcgcgcggcggcgcgttcttccgcgcccggcccgcaccggccatcgtccgactcctcagttcttcggctgctgctgggtgatgcagtggatgcccccgcctccggagaagatcgtacgggcgtccaccagggtcaccgtccgctcggggaacaggcggcggaagatcccggccgcggtctcgtcgcgcggatcgtcgaagccgcagagcacgacgccgccgttgcacaggtagtggttgatgtaggagtagtcggcccagtggccgtccgcctccaggaccgtcggggcgggcacctcgacgacctcgatgcgccggccgtgcgcgtcggtcgccgccttcagcaggccgatgacctccttgctgacctcgtggtcggggtgggccgggtccggctggtggtgcgcgacgacgacgccggggcgggcgaaggcggcgacgatgtcgacatggccgagggtgccgaagccgtgcggcgggtagtcgccggtcagtccgcgcggcagccagatcgccttgctggtcccgaggtgggcgtggatctccgtctcgacctgctcgcgggtccagccggggttgcgctcggcaccgagctgcacggtctccgtgagcaggaccgtcccctcgccgtcgacgtggatcgcgccgccctcgttgaccagcttcgaggcgtacgtcttcgcgccggcgaggtcaccgacgtacgcggcgatcttcgcgtcgtgctcccagcgggcccagctctgggcgccccagccgttgaacgtccagtcgacggcggcgagtccgcccttcccgtcggtcaggaaggtgggaccgatgtcgcgcatccaggcgtcgtcgaggtcgcgttcgacggtgtcgatgcccgggcccagcaggtctcgcgcctcggccgaccgccccggcccgcacacgacggtgaccggctcgaagcggcgtatcgcgcgggccacatccgcccaggcccggcacgactcggcgaggtcgtcggggtggtcgaaggtggggttggggcccggccacgccatccaggtgcgctcgtgcggggtccactcggcgggcatgcggaagccgtcggcggcgggggtgctcatggcgggtccttagaggaagtacaggcggttgagggagaccgagtcggcgggctcggaacggatcgggtcgccgtcgagggtgaccaggccggtgcgctggtcgacgtcgaccgctccggtgcgggagttgaggcgcaggtcggcggggccgatgccgcgggtgccgcgcacggcgaccctccgtcggcgggtcggcatccggtcgttgccctggtcgagcgccgcctgcgccacgaaggccaccgagatctcggcgggcgtcgccccgtgcgccccgaactgcggcccgaggacgaggggttcgcaggtgtcggtcgcggcgttcgggtcgcccacgaccccgtacgcggggaagcccgacttgagtacgagctgcggcttggcgccgaagaactccgggcgccacagcacgatgtcggcgagcttgccgacctcgatcgagccgacctcgtgggcgagcccgtgcgcgagggcggggttgatggtcagcttggccaggtaacgcaggacgcgcgcgttgtcgtggtcctcgggggcgccgaactcggccttcatcttcccggccatcgcgaaggtccgtcgcacggtctcgcccgcccgccccatgccctgcgcgtccgacgaggtgatgccgatcgcgcccaggtcgtgcagcacgtcctcggcgcccatggtcccggcccggatccggtcgcgggccatggcggcgtcgccgggcaggtcgggcttgaggtcgtggacggagacgatcatcccgtagtgctcggcgaccgcgtcccggccgaagggcagggtcgggttggtggacgagccgatgacgttcgggacgcccgccatcttcagcacgttcggtacgtgcccgccgccgcagccctcgatgtggaaggcgtggatggtgcgcccgtcgaggacccgcagggtgtcctcgaccgagaggcactcgttcagtccgtcgctgtgcagggcgacctgcacatcgtgctcctcggcgacgcgcagcgcggtgtcgagggcacgggtgtgggcgcccatgtcctcgtggaccttgaagccggacgcgccgccctcggcgagtgcctcgaccaggggcgccgggtcggacgacgaaccccggcccaggaagccgatgttgaccggccaggcgtcgaaggcgctgaacgcgtgccgcagcgcccagggcgagttgacgccgacgccccacacgggcccgaactcctggccgatgaccgtggtcacgccggaggcgagggaggcctccatgatgcgcggcgacagcaggtggacgtgggtgtcgacggctccggcggtggcgatcagcccctctccggagacgatggacgtgccggtgccgaccacgacgtcgaccccggcgagggtgtcggggttcccggcccgtccgatcgagcagatccggccttcccggatcccgatggacaccttccggatgccctgcgccgcgtcgatcacgacgacattgctgatgacgacgtcacaggtgtcgcggacggccgcggccttgaggtgcagtccgtcgcgggcggtcttgccgaacccggcgaggaactcgtccccgtactgctgggcgtcggactcgacgcggatcgtcagccccgagtcgccgaggcggacccggtcgccggcccgggggccgtgggtggcggcgtatgcgtagggattcatcgctgctcgactccgagatatccgcaggcggcggccctgcgcagggcctcttccttcgccccaggcgcgtccagcggcccgtcgaccagaccggcgaacccgatcgcgatccggtcgccgccgacgggcacgagcccgatctcgacgctctcccccggcccgaaccgcaccgatgagcccgcgggcacggccgcccgcatgccgtaggcggccgcgcggtcgaagtcgagccgcgggttggcctcgaagaagtggaagtgggaggtgacggagacgggcacggtggccgtgttggtgacgagcacccgtacgacggcctcgggctcggtgtgttccggccccggcagcagcgcgcccggagcctggtcgcccagccctcccccgatcgggtcggtcaccaccgcgagccgcgaaccgtcgtcgaagacagcctcgacatgcacctcggtgacgatgtcggcgacgcccggcagtacgtcgtccgggccgagcacggctcgcgcggcggcgatcgcctcggcgagccggcgcccgtcccgggcggcctcacagacggtgtcggcgatgagagcggtcgcctccggcacattgagccgaagaccgcgcgccctgcgcgcccgggccagctccgcggccccgaagagcagcagccggtcacgttccgtgggggtcagccgcacgtgaacgacacctccttgcgtttccgcgatttagagcaccactctaaccacgacactcgccgaacgggaacattgatccatgaacttgggtcatgtcacattgaacactgctcaaacatcgcgccggccgacctcgccgatcacccgcaagcccccgggtacacgacagggccgccgcggacccttgagtccgcggcggccctgaacagccatgagtgagggcgaggccctgtcggtctagcccagcgggtgcatccagccgtgcttgtcctcgccgatgccgcgctggatgtcgaggagggcctcgcgcagcttcagggtgacctcgcccggctcaccgcccgagtgctgccactcggcgctgctgcgcttgaccgtgccgaccggcgtgatgaccgcggccgtaccgcaggcgaagacctcggtcagcgtgccgttctcggtgtcggcctgccactggtcgatggagacgcggccctcctcggactcgtagcccaggtcacgggcgaccgagagcagggagtcgcgggtgacgcccgcgaggagggagccggtcagggcgggcgtgatgatcttgttcccgtacacgaagtacaggttcatgccgccgagctcctccacccacttgtgctcgaccgcgtcgaggtacgcgacctgggcgcagcccttctcggcggcctcggcctgcgcgagcagcgacgcggcgtagttgccgccggtcttggcgtcacccatgccgccggggacggcgcgcacgcggtcctcggagagccagatcgagaccggcttcacgccgcccgggaagtacgcgcccgccggggacgcgatgacgaggaagaggtactcgttggcgggcttcacgcccaggccgacctcggtcgcgatcatgaacgggcgcagatagagggattcctcgccgccgtgcgccggcacccacgacgcgtcctgctggaccagcacgtcgcacgcctcgatgaacgtctcgaccggcagctccggcattccgaggcggcgggccgaggcctggaagcgcttggcgttcatgtcggggcggaaggaggccaccgagccgtcgggctggcggtacgccttcaggccctcgaagatctcctgcgcgtagtgcaggaccatggtggccgggtcgagggagagcggggcgtacggaacgagctggccgtcgtgccagccgcgtccctccgtccacttgatcgtcaccatgtggtcggtgaagtggcggccgaatccggggctggccaggatcgcctcgcgctccgcgtcggagagcggactggcggagggcttgagctcgatcgtgggcgtcgtcatgagtggttgtccttcaccggttgtgtgtggcgggccgcgctcacgcccgtaccgccagtggccagtgcgtggacgtccgagcattccctcattccgcggctccgcgttcgattatcgctcgcggttcgccgtggctgtgaacggtgtgcgtgcggcccagggaagtgcccaggggttgatggtggcacccggcgagggcataggaaaagccgccgggtgcggatgcgacccggcggctgtctctcaaagggcagtggcgcggcgggtcagcctgctactcgtacggtgagcgcgtcaccgatctcgtcggtgctgcgggcgggcttgcccacacgctccgcgaggtcggcggagacggcctcctcgatacgcgcggcctcggcctcgtagccgaggtggcgcagcaggagggcgacggacaggatcgtggcggacgggtccgccttgccctggccggcgatgtcgggtgccgagccgtgcacgggctcgaacatcgacgggtacgcgccggacgggttgatgttgccggaggcggcgactccgatgccgccggagatcgccgcggcgaggtcggtgatgatgtcaccgaagaggttgtcggtgacgatcacgtcgaagcgctcgggctgcgtgacgaggtagatggtcgccgcgtccacgtgcatgtactcggtggtgacgtccgggaactcctcgcccaccttgttgaagatgtccgtccacaggtgaccggcgtgcacgagcacgttgttcttgtggacgagcgccagcttcttgcgggggcgggcctgggcgcgggcataggcgtcgcgcaccacgcgctcgatgccgaaggcggtgttcagcgagacctcggtggcgaccgcgtgcggggtgccggtgcggatggtgccgccgttgccggtgtacgggccttcggtgccctcgcgcaccaccacgaagtcgatctcgggctggccggcgagcggggtctcgacgccggggagcagcttcgagggccgcaggttgacgtggtggtcgaaggcgaagcgcagcttgagcaggaagccgcgctccaggacgccggacgggaccgacgggtcgccgatcgcgccgagcaggatcgcgtcgtgctgcttcagggcgtcgaggtcggcgtcggtgagggtctcaccggtggcgtggtagcgccgggcgccgaagtcgaactccttggtctccagcttcacgtccgagggaagggcggcggagaggaccttgagcccctgggccacgacctcctggccgatgccgtcaccgggaatcactgcgagattgatgctgcgagccatgacggcaccgtactccttgtcccatgggatgacacggggtgtccgcgatacggacacatcggggtggccgtacacgcctcacgggtcaatccgtcggctgccgttcacccgtacgtttggcggtcgttgggcttcgctgggaagttcaccggcatggacaccccgaacgtcggcatccccgagcggctcgcgcgccgtatgagcatggcggagcagtacgagtacctgcgtacgaagctgtcccggcgtggcgtgctgctgaccgcgggcggggtggccggcgggctgctgaccggctgtgccgggtcgggcacggcaaccggtaccccgtcgtccgcgcccgccaccgggacggtgcacggctccgccgtggcccccttcggccgccatctcgccttcggcgcggatccgaagacacagatgcggatctcgtggcaggtgccgctcgcggtccaaaagccgtatgtacgggtggggctgaagcccaccgacctgagccggaggatggcggccgaggtccgggatctgcacacgccggggctgaccgggcagcggttcgcggtggaccagtactacctgcacgcggccctcgacggcctcaggcccggtacgcggtactactacggggtcgggcacgacggcttcgacccggcgtcccgggagcggctgtccacggtcggctccttccgtacggcgcccgcggctccggagacgttcgtgttcaccgccttcggcgaccagggggtgagctacgacgcgctcgccaacgacaaggtgatcctcggccgccacccgtccttccacctccacgcgggcgacatctgctacgcggacacgaccgggcacggcgaggagtcggacatctacgacccccgggtctgggaccagttcctcgcgcagaccgagtcggtggcgaagtcggtgccgtggatggtgacgaccggcaaccacgacatggaggcgtggtactcgccgaacgggtacggcggccagtcggcgcgctggacgctcccggacaacggcttcgacccgcagaaggcgccgggcgtctactcgttcacctacggcaatgtcgggatcgtggcgctggacgcgaacgacgtgtcgtacgagattcccgccaacaagggctttacgggcggtcggcagacggcctggctcgaccggcggctcggcgaactgcgcgcgtcggcctcggtggacttcgtcgtggtcttcttccaccactgcgcgtactcgacctcgacgcacgcctccgacggcggcgtgcgggacgcgtggctgccgctgttcgccaagcaccaggtggacctggtgatcaacgggcacaaccatgtgtacgagcggaccgacgccatcaagggcggccgcgtcggcagggcggtcccggtcggcgcgtcgaccgacccgacgcgggacgggatcgtgtacgtcacggcgggcggcgcgggcaagagcctgtacagcttccccgacggggtcaaggacagctacgaggggaacgtggccgaccgcgagtccgtggacaccttccactggaccgaggcgcgccatcgcaaacacgacaccgtggagtggtctcgggtgcgctacaccggcttctcgttcctctcggtggaggcggagaccggcgcggcggcgaagctcaaggtgtcggcgctggcgcagagcggcgagcggatcgactacttcgaggtgcggcgcggggcgtgaaggtccgaggtgcggtgcggggcgtgagcccatggctcacggccgcgccgcaccccgtgcgggcgcggctcccggctacctggtgatgcccagtgagggcggggttcagtgcccggtcttcccgccgttgtcccggcggtcgagggcgcgctggagggctgcggcggcgttcttgcggtcggattcgctcgcaggggagatgtgacggactcggcggcggacggtcgtctcggccatgggaaatcgactccttcgaaattccgggagcggaaaggggttacgagacgccggatggggcggggagcggtgccgcaggggttgcctgccaggggctccggctcacgaccgccattcgcttgatcgagcgagacgttcggctcctacaaaactaagcgagaggcgcgcatctgtctctacagttagtcggacttcctactatctgagacggcggatcgggtcacactcgcctgacctgcggtgattgttcgggcggcatcacccgccgcgggatgcagccgcagggcagcgactccctggccggcgcccggtccgggaccgtcccggaccgcgaccgcccgcgacggcgaccagcccgcccccgccgacgccgaggcctctccccagaccgggcgcgttcccgtgccgggcgtcttcgtcagagcacgtcaccgtcgcgccagtcgaagaccaggtcgtacgccgggtcgagggggccggcccccgcggcgcgcacgaaggtgctgccttcctcccccggcaggcgcacgatgccgtcggggccgagcgcgccgatccggcccggccagacctgccagccccgggccgcgtacagggcggcccccttctcgctcgccgagagcgccccgaggtcgtacgccccctccacgatccgctccagctcggccatcacccgcccgcccagaccgctccggcgtgcctcggcacggaccccgaccgcctccacgtagccgacgcgcagcgagcggccgcggtgcagcacgcggcgctgaatgacggagccgtgggccgcgagcccccgcgcgtcgtacacgaggacgtggagaccaccgagcccgtggtcccagtcctcgtcgtcaaagcccccctcgaaggcgccgtccaacaaggagcggacggaacggagttcggcggcggtgagatccacggtatgggcggtacggagtcggatggccatcggcccagtatcgcggacacccaccaccacctaacccctcattaactcttgactggttagatatgggcgtggtggactgaacgccaccaccaaaaagggtttcagaggttaggggcgcgtacatgaccacgcaccggatccaccaccgcaccgccaccgtccgcggccacgagatccactaccgggaggcggggccggccggcgccccggtactgctcctgctgcacggcttcccgaccagttcgcacatgttccgcgacctgatgccgctcctcgccgaccgctaccacctggtggctcccgaccacctgggcttcggccgctcgtcggcgccggccgccacggagttcccgtacacgttcgccggactggccgagatcacggacgagttcaccgaacagctcggcctgaaggagtacgcgctctacatccaggactacggcgccccgatcggcctgcggctcgcgctcgcgcaccccgagcgggtgacggcgatcatcacccagaacggcaacgcgtacgaggacgggctgggcgccgaggcctgggcacccgtcctcgccctgatcgcggagcgcacacccgcgaccgaggagcccgtccgcgcgctcagtggccccgagggcatcaagtggcagtacctgcacggcgtcccggaccccacgctggtcagcccggacgcgtacgaacacgacgcggcgctgatggcccgccccggtcagtccgagatccagctcgacctgatctccgactacggctccaacttcgccctctatccggcgttccaggagtacttccgcaccagccaggtcccgctcctcgcggtgtggggcggccacgacgagatcttcgtcccggcgggcgccctcgccttccagcgcgacctcccgacggccgagatccacctcctgcccaccggccacttcgccctggagacacacgcgggccaggtcgccgccctgatggacgacttcctggcccggcgggtgtgactggacgtcagcccatgtgcgggtacgtgtagtcggtcggcgggaccagcgtctccttgatggcgcgggtcagcgtccagcgcatcaggttctgcggggcgcccgccttgtcgttcgtgcccgaggcacggccgccgccgaagggctgctggccgacgacggcgccggtcgacttgtcgttgatgtagaagttgcccgcggcgtagcggagcttgtccatcgtgtacgcggccgccgcacggtcgttggagacgaccgcacccgtcagcgcgtagtccgaggccgactccatctgggtcagcatctcgtcgtacgcgtcgtcctcgtagacgtgcacggcgaggaacgggccgaagtactcggtcttgaagacctcgttctccgggtccgagcactcgacgaccgtcgggcgcacgaagtagccgaccgagtcgtcgtactcgccgcccgccacgatcgtgcaggtcgggtccgacttggcgcggtcgatggccgccttgttcttggcgaacgagcgctcgtcgatgaccgcgccgacgaagttcgacaggtcggtgacgtcacccatggtcaggtagtcgacctcggccgcgaactcctccttgaagccggagttccagatggaggccggaaggtaggcgcgggaggtcgcggagcacttctggccctggtactcgaaggcaccgcgggtcagggcggtcttcaggaccgcgcggtcggcgctcgggtgcgcgaccaggaagtccttgccgccggtctcgccgaccaggcgcgggtacgagcggtacttctcgatgttgttgccgaccgtcttccacaggtactggaaggtcttggtcgaacccgtgaagtggatgcccgcgagatcgcggtgctccagggcgaccttggagacctcgatgccgtcaccggtgacgaggttgatgacgcccttgggcaggcccgcctcctccaggagccgcatcagcagcacggcggcgtgggtctgcgtcggggacggcttccacacgaccacgttgcccatgagcgccggagccgtcggcaggttgcccgcgatcgccgagaagttgaacggggtgatcgcgtagacgaagccctcgagcgggcggtggtcgaggcggttccagacgcccggcgagttggccgggggctgctcggcgagcaggtcgcgggcgtacttgacgttgaagcgccagaagtcgaccagttcgcacggacagtcgatctcggcctgctgggcggtcttcgactggccgagcatggtggaggcggcgagggtctcgcgccacgggccggacagcagctcggcggcgcgcaggatgatcgcggcgcggtcgtcgaaggacatcgcgcgccaggccggggcggcggccagcgcggcgtcgatcgcgtcctgcgcgtcctgctgcgtggcgtgcgcgccggtgccgatgacggccttgtggttgtgcggctgcaccacctcgaagcgctcaccgccgccgagccgcttctcgccgccgatggtcatcggcagctcgatcgggttctcggccagctccttgagcttggcctccagacgggcgcgctcgggcgagccgggggcatagccgtgcaccggctcattgacgggggtggggacctgggtcacagcatccatgggttccgtaactcctaactgagcgggtgggtcagcccttggtgagaatcgagcgggcactgtgctgttccgggggacgcagcacctgacagtggctgcgccacgggccggactcccggcagcgcgtccgggtgatcgtcatctctcaacctcgggtcagcatgctgcgggcgaaaaagcgcaggttggccggcttctccgcgaggcggcgcatgaagtagccgtaccagtcggtgccgtacgccgtgtacacccgcatccggtggccctcggctgccaggcgcaggtgctcctcgccgcggatgccgtacagcatctggaactcgtactcgtcgagcttgcgtccggcgcggcgggccagctcctgggcgatggagatgaggcgcgggtcgtgggacccgatcatcgggtacccctcaccctccatgaggatcctcaggacacggacgtacgccttgtcgatctcggacttctgctggtacgcgacctcggcgggctccttgtacgcccccttcacgatacgcacccggctgccgttcgcggcgaggcggcgggcgtcggcctcggtacggaagaggtacgcctggatgacgcagccggtccccgggaagtccttgcggagctcctcgtggatggcgaacatcgagtcgagggtggtgtggtcctccgcgtccagcgtgacggtcgtgccgatggcggcggcggcctcgacgaccgggcggacattggcgagggccagctcgtgaccgccgtccagcgcctgcccgaacatcgacagcttgacggacatctcggcctgggtgccgaggtccagctccttgaggcggccgatcagttcgaggtacgcgtcccgggcggcgtacgcctgctcgcgggtggtgatgtcctcgccgacgacgtcgagggtgacctcgagccccttggcggcggagtcctggacgaccggcaccacttggtcgacgctctcgccggcgatgaagcgggcgaccacctgcttggtgccgggggccgccgacacgaagcggcgcatgcggtcgctgcgcgacgcggcgagaatcacgggacccagcacggggcacctccagaacaagcgtgaccaagaggccgtcacccgaccattcgggtacggcccggagaaccaccgtgaaacctaaggatctctccgatggtctgccatcgacagctgtcacgcatccgtgccctggatctcagacatttgtatgagggcgctcgggaaatgcgggagaatgcccgagtgaaggccgattacaagggtgactaccaggagctggtcgacgagatctcggcgctcctgggcgcccccgcgacgctggagaaccgggacttcgaactgatcgccttcgccgcctacgacagtgacggcgacggcggcttcgacgaggcgaccctggacccggtccgcacccgttcgatcctcacgcgccgctcgaccccggcggtgcggaagtggttcgagggcttcggtatcgcgcaggcggccggcccggtccggatcccgccgaccccggaggcgggggtccaccggggccgcgtctgtctgccggtacgccatcggggggtggtgctgggctatgtgtggctgctggacaccgatccggggccgtccacggagcagctggccgccgccatggaggtcgccgcccgtatcggcgcgctcctcggcgacgaggcgcaggcgggcgcggacctgacccgtgaactgcgggcggtgctcaccgcggagcgcggctggcagcgggacatggcggtcgcggagctgcgtacggccctcggtccgcgcggcgacagcctgcacacggtggtctgcgtggccccctggccctccgccgacccggacgacgcgccttcggtgcgtacggtgccgggggcgaccgcgctgtgcacggtgccgtgggggacgaccgcgcagagtctggcgctgctggtgcggctgcgctcggcggacgtcctgacgccggcgctgaccgcggccgcccggctgctggagcgcgcccggggcggcacagcggcggcggccggggtcgcggtcgcccgcagcgggctcgtcgaactgggcaccgcctggcaggaggcgtcggccgccgcgcgtgcggtgctggcggagccgcggctcgggccggtcgccgagtgggcgtccatcggcccgttccggctgctgaccgcgctccctcccaaggcggcgcacgaccccgccgtacgcaccctgctctcccccgcccaccgcgaactggcccgcacggccgaggtgtacctggactgtgcgggccaggcgggccgcacggcggcggagttgggcatccaccggcagacgctctactaccgcctgtcacgcgtcgaacagctcacgggcctggacctggacgacggcgaggaccggctgctgctgcacatggcgttgaagggggcgcggctttgagggcggggcgctagcgctccgctgtaagtgcccgtcgcggcgcccggtcgtccccctcacccgttctcgggctcgccctctgcctcgtcctcgtcctcgtacagaccctccagcccgctgacgcactcctcggcgaccgtgacggcgaaccgcgggcaggtccaggcctccgggctggggcactcctcgggtggcgggaactcctcgggcgcgtagaagtggagcatggcgtcgcggaactcctcgtaccgcagcggcgggtgctcgtcgtcgtgcgcgcagcgctcgaggcggggtgcggcggcgacggtacgcagggtcgcgaggacgccgcggaccaccgacaggggcgggctcggatacgagatctccgtcgcctggtgggcggcgagcagcagcaccgcacgttcccgcccgtcggcccgctcgtggcggcgggcggcccacagggccagatcgtcggcgtactcctcgttccagctgtggtgggcgagccgctccacgatcctcgcgatctccagccgtccgtcggcccgcaggtactcggcgtccaggtgggaggtgtcgcggttcccgaagagcacctcgcgccgctcgcgcagcatcgtcagtgtcctgtccgcgacctccgccatgaagaccgggcacagtacgtgctccagcggagcgccccgccccgactcggtacggtcgcgttcgtacctgccgcgcccaccggcgctgctcaggcggacgccgagttccgcggcgtccgggccgctgtcgggcagggtcgcatgccactcgtgggcgcaggacgcggcggcgaagtgcggcaacgccttctcgaccgcttcggccaggtcgtcgaggacggatttcgtacgcaccattccggagacggcgtaccaggtcaccgccctgacgaccagcagatgtccggcgcggtccgccggttccgcgcacgagaggttcgacgcctgcgaggagatctcgtcgtcgatgtcggtccccgggtgggggtagccgtgcagcagcgccgacagcgtgtcgatggtgtcctgggcctcggccggcagacggggcggcacatctgtgaccgatcccgggtcgacgacgtccagggcgatccgcgcgaatccggcgacgttcggcgggcagagccattcgtcccggggccgttgcccctcccggtcggcgcgctcgtcggcgagcggggccagttgctcggtcagatacgggtcgtcctcggcgtcatggacctggtacgggtgggacgcgtggtcgcacggccggtcgcgcagcgcctcgtcggcggcctccagcgcggcgacggcggccgtggtgacgccctcgcccggaagccagttgacgtagggggccatcaccagcagccccagcgtccacacgtacgccgccccaccgccggggtcggcggcgaggcgggccgcgcagtcgaggaccgtccggtcgtactggtcgttgtagtagtcgcggtggttctcgcggacttcgtcccaggaccgggagagctcatcgagcgacgtgccgttcatgtccatcacgatcttcacgacgcgccgccgggcacgggagttccgccgcgggtccggcgatccggtcgtcgtcggacagcggcgaagccggctgctcggtcgtcggccggacagcggcgaagccggctgctcagcccgtcggcttggcggccgcctcgatcacgcgtcgcaggcccgcggtgagtccctcggccgtggacgcgctgtcgggatcgaagagccactggaggcacagtccgttgagcagcgtctggtagaagccgccgagcgtccgcaacgcctcgtcgtcgacgtcctcctcgcgaccgcccatgaacatggggatgaggccccggcgcccctcgtcctgggccttgaccaggtgctcgcggaccgtgggaagccggtcggcgttggtgaccacctcgaaggtgagcagccagatcgggcgggcctcggtgaaggacctgatgacgcccctccaggcttcctcgaagcgttcgagggaaccgggctcccccgtcgcggcgccttcgtcgaacgccccgaacgtgtcgccgacgttcgagatcagatcgacgtacgcctccgcgagcaacgcgtccttggacccgtagtggtagccgatcgaggccaggttggtccccgactccttcacgatgtcgcgcgcggtcgtgcgcacgaaccccttctccaccaggcagcgcttggcgccctcgagcagatcctcacggtgtcccatgcccgccaccctacaaccgggacagacaagcgtcctagacacatgacttatacaattgttctagacaagcgtttaagacgcccgtatggttcctggcatgacgaacccgacgagcacgacccccgcacccggcgcacctggcacccgggccggccgccgtgaatggaccgccctctgcgtcctgatgctccctctgctcctggtctcgatggacgtctcggtcctctacttcgcgatcccctcgatcacggcggacctggagccgagcagcacccaacagctgtggatcttcgacatctacgcgttcgtgctcgccggcctgctgatgacgatgggctcgctgggcgaccgcatcggccgccgcaagctcctcctgatcggcgccgcggccttcggcacggcctcgctggtggccgcgtacgcgaacagcgccgagaccctgatcgcggcccgcgcggtcctcggcatcggcggcgcgaccctgatgccgtcgacgatggcgatcgtgcgcacgatgttcaccgaccccgggcagcgggcgaaggccgtcggcctgtggtcgggtgtcatgacggccggcatcgcgctcggctcggtgatgagcggtgtcctcgtcgagtacttctggtggggctcggtcttcctggtcaacctgccggcgatggcgctgctcctggtcctcggcccgatcctgctgccggagtcgaagaacccggacccgggccgcttcgacctcctgagcgtgccgctgtcgatggcggccgtactcccggtgatctacgggctcaaggagatcccttccgagggctggcacgcctcgtacgtggtgtgcgtgacggtgggtctgctcttcgccgccctcttcgtccaccgccagcgcacggccgcgtcgcccctgatctcaccggccctcttccgggcccacggcttcacccccgccatggtcctcaacctcatctcctgcttcgccatgctgggttcggccttcttcaccacgcagtacctccagtccgtcctcggcaacagcccgctcgaggcggccctgtggtcactgctcccgtcggtgctgatcggcttcgcggcacccgtgaccacccagctcgtacagaagggcgtgaaccgcgcgtacgtcgtcagcgccgggttcgtcgtcgccgcgggcggctacgggatgctggcgctcgccggtacggactcgatgtggctggtgctggccggggcgggtgtcctcgcctccgggatcgtcaccgtgatgtcccagatgatggacctggcgatgggcgcggcaccgttggagcaggcgggcgcggcctcttcgctgatggagacgagcgcggagttcggcggcgcgctgggcatggcggtcctgggttccatcggcacggcggtctaccaccacgagatcccggcctcggccccggctcccgcccacgagacgctgggcgcggcgctggcggtggcacaggagctgccgggcggcgcgggcaccgcactgatcgcggtcgcgcgggacgcgttcaccagcggtatgcaggcggcggcgctcgccggggcggtactcctgctgggcgcggcgttcctggcgacggcgacgctgcggaaggtggccgtgcgcgagagcgagtccgcgacgccggaacaggtgcccgccgcctgacggcaccaccggtgggcccgagccggttccggaggagcggctcgggcgcaccggcatgctcgggcccactcgacgtactcgggcccactcgacgtactcggacccaccgacgtactcggacccaccgacgtactcgggccccccggcgtaaggagcccggccccggccccggcgcaccgccgcccgtccgcccccaacgcggcccgcccacccccacgaccccgcgtgccaggatggacccgtgccgcagctcccgccttccgtcgagaccccgttcatcggccgtgcagccgaactcgcccgcctcaccggcgtactcgaccgcgcccgcggcggcgacccccgcgccgtactcgtcgcaggcgacgccggcgtgggcaagacgcgcaccctcgccgaagccgccgcacacgccacccgcaccggcatgacggtcctcaccggccactgcgtcgacctcggcgacgtgggtctgccctacctcccgttcacggaaatcctcggcaccctcgccaccgacgaccgcctcgcccccgccctggcagcccaccccgccgtcgaccgcctcctcggcggcggagccgacggcagccggctccagctcttcgagagcgtcgccgccctcctcgccgacctctccgaacacggccccctcctcctcgtcctggaggacctccactgggccgaccagtcctcccgcgacctcctccgtttcctgctcagccggggcgtgctccaactccccacggccggcgcccccgcccaccgcctcgcggtcttcgcctcgtaccgggcggacgacctccaccgccgccacccgctgcgccccctgctcgccgagctcgtacggctgcccgccgtcgaccgcctggagctgcgcccgatggccgacgccgaggtcacccgcctcgtccgtgccctgcgcgccggcccgctccccgacaccacggtccgccggatcgtcgaacgcgccgagggcaacgccttctacgcggaggaactgctggccgccaccaccgacacggccaccgggacgggcgagcccccgcacgagtccatggacggccccaccccggcgctgcccagcggcctcgccgacgttctcctcatccggctggaacaactgtcggacacggcccagcaggtgctgcgcacggccgcggtcgccggccgccgcgtcgagcacgacctgctgcgcgaggccgtccaactcccggacgacgaactggagtcggcactgcgcgaggcggtcggccgccaactcctcgtcccggacgaccgcgacacctactcgttccgccacgccctcacccgcgaggcggtctacgcggacctgctgccgggcgaacgcgtgcgactgcaccgcacgttcgcggggctcctcaccgccgcgggccgacacgacggcccacccggctctcaccccgccaagaccgccgccgaacgcgcccaccactcccgcgagagccacaacctccccgacgcgctcagcgcctccctcgaagccgccgaccacgcccagcggctcggcgcgcccgccgaggagctgagccacctcgaggcggcgctggagctgtggccggccgtggcccccgcggaccgccccaccacgcccggcctggacacggtgacgctcacgctgcgcgcgtccgcggcggccgcgcacgccggcgagagccaccgcgccgtctccctgacccgcgccgccctcgcccgcgccggcacggacacggactcggaactcgccgcccgcgtccgctacaccctcgccggcaacctgatgcgcgtcgacagcctcaaggccgcgttcacctacagcagcgaggcgctcgccatgatccccgccgagcccccgtcccgtacctgggtgtgggcggcggccacccacgccatggccgcgcgctacgtgggcgaggacgaggacgccgggcgggtggcccggcaggccctggccgtcgccgagcggctcgaactggccgacgcccaggccgacttgatcgtctccctggtcggcctggacggacacgaccggcgtacccccgagggccgggaccggctgcggcaggcccgcgaactggcccgccgcgcgggcaacgtgtcggtcgagatgcgcgccctgttcaacctggccatcggcgcctacgagaccggcgcgctggacgactgcctgacctggctgtccgacggactggaccgggcgagccgcaccgggctgctgtcctcgccgtacgccctggagctgcgctacctccagtccctgatcctctacaccctgggccgctgggacgagtgcgcccgggcggccgccgccgacgccgaacggctgcccgcggcagccggattcgccatcggccccgcgctgtatgtggcgctggcccgcggcgagcggtccgccgccgaccgcgcccaggcgctcctcgacgggccgtccgagtggatggccacgctcgtggccggcatcgtgctgaccgacgccgcggccctgcggggcgatccggaggcggccgtcgagcgcgtccacggcacgctggccgcgctggccgacggcgcggtcaacgagcgcccggacgtcggcgtacggcttgccgcgctcgccctggccgcggtcgccgacgcggccgaggaggcgcgcctgaccggcgacgcggcgaccgtccgccgctggacggacaccgcggccgagctgctggagctggcccgcaccacggccgaccggggcgaggacggaaccgagcagggccccgagggcgtggcctggctggcccgcgccgaggcggagtggacgcgcacggtgtccggtccggacgtggtggtgtgggagaaggcggtgaccgcgttcgcgtacggcgatccgtacgagcgggcgcgttgccggcgccggctggctcaggcgctgctcgcggcgggccgtcgcgaggaggccgccgagcaggcccgggcggtccgcgagaccgccaccctcctcggcgccgcgcccctgctcgacgccgtggagacgctcgtccgccgcggccgcctcgccgagacctcacccgcggcggacggcaccgcggtactgacggcccgggagaacgacgtactccgactgctggcccgcggccgcaccaaccggcagatcggtgaggagctgttcatcacgggcaagacggcgagcgtccacgtctccaacatcctggcgaagctgagcgcggcgagccgcacggaagccgtcgtgatcgcgtaccgggaggggctgctcgaaccggagccgacctgacggctcacccgagcgctccacggcccgcgcaacacagtgggggcccggccaccacaggtgaccgggcccccacttccgtacgacgaaccgtcagatcccgtacgacgaaccgtcagacgaggttgaccgaccgcgccgaggtcgcgccgatctcctccgccagctccgtcagcacgttctgcgacacggtgtcgtcgaccgtgagcaccgcgagggcctcgccgccggcgaccgcgcgggacacctgcatgcccgcgatgttgatgccggccccgccgaggatgcggccgagcgtgccgaccacacccgggcggtccgtgtacttgaggacgaccatgtggtcggcgagcgccagatccacgtcgtactcgccgacggccacgatcttctggtggtgcttcggaccggccagcgtgccggagaccgacacctcctcgccgttgccgagcgtgccgcgcacggtgatgacgttgcggtggtccgaggactccgagctggtcgtcaggcggacctcgacgccgcgctcctgcgcgaacagcggggcgttgacgtacgacacggtctcgtcgacgacatcctcgaacacgcccttgagcgcggagagttcgagcaccttcacgtcgtgctgggtgatctcgccgtacacctcgacgtcgaggcggaccgcgacctcgcccgagagggcggtgaagatgcggccgagcttctcggcgagcggcaggcccggcttgacgtcctcggcgatgacgccgccctggacgttcaccgcgtccgggaccagctcaccggcgagggcgagacggacggaccgggcgacggagataccggccttctcctgcgcctcgtccgtggaagcaccgaggtgcggggtgcagacgacctcgtcgagctcgaagagcggggagtccgtgcagggctccttcgcgtacacgtcgaggccggcaccggcgacgcggccctccttgagcgccgagaacagcgcctcctcgtcgacgatcccgccgcgcgcggcgttgacgacgcgcaccgtcggcttgaccttgcgcagcgcctcgtcgccgatgagaccgagggtctcgggggtcttcggcaggtgcacggtgatgaagtcggagacctcgagcagctcgtcgagggagaggaccttcacgcccatctgcgcggcccgggcaggctgcacgtaggggtcgtaggcgacgaccttcatgccgaaggccgacatgcgctgggcgacgagcgcgccgatgcggccgaggccgaccacgccgagggtcttctcggccagctcgacgcccgtgtacttggagcgcttccactcgccgttcttcagcgcggagttggcctgcggaatgttgcgcgcggtggccaggagcagaccgcaggccagctcggcggcggtcacgatgttcgaggtgggggcgttgacgaccatcacgccggccttggtggcggcggagacgtccacgttgtccaggccgacgccggctcgtgcgacgaccttcagcttcttggcggcggcgaccgcctcggcgtcgaccttggtggccgagcggatcaggatggcgtccacgtcggcgatcgccggcagcagctcggcgcggtccgcgccgttgcagtgccggatctcgaagtccgggccaagggcgtcgacggtcgcgggcgacagctcttcagcgatgagtacgacaggtttcgagctcacgtgagtcctcacaagtccaatgcggacggccgtcccgacggccgcaggcggtggaggggtgcttgccgcgtggaagacgcacgacgttgtgggcctgaacgcgtatgtagtgcagcagtctagtggcgtcgcggacgtcgccttacgccgctgcggaaggatcacccgtccgtggctggacggggtggacaacggcctgttcccaggcgttacccggggttcgacgaaggggccggagcgtcacgctccggcccctcgccgtcgggcttacgcctcttcgtcgttcacccagctcatgagcttgcgcagctccttgccggtggtctccaggaggtggttctcgtcctgggtcttgtactcgttgtacttcttcagaccgccgtggtactcgtccatccaggcctgggcgaacgtgccgtcctggatctcggcgaggaccttcttcatctcggccttggtggcgtccgtgatgatgcgggggccggtgacgtagtcgccccactcggcggtctcggagatcgaccagcgcatcttctccaggccgccctcgtacatgaggtcgacgatcagcttcagctcgtggaggcactcgaagtacgcgatctccggctggtagcccgcctcggtcagcgtctcgaagccggccttgaccagcgcggccgtaccaccgcagagaaccgcctgctcaccgaacaggtcggtctcggtctcctcggtgaaggtcgtcttgatgacgccggcgcgggtgccgccgatgcccttcgcgtacgagagggcgagcgcgaagccgttgcccgtcgcgtcctgctcgacggccgcgatgcacggaacgccgcggccctcctcgtactggcggcggaccaggtggcccgggcccttgggggcgaccatgcacacgtcgacgccggccgggggcttgatgaagccgaagcggatgttcaggccgtggccgaagaacagcgcgtcgccgtccttgaggttgtccttgatggactcctcgtagacctgggcctggatcgggtccgggacgaggatcatgatgacgtcggcctcggcggcggcctccgacggcgtcaccacgcgcaggccctgctcctcggccttcgccttggacttggagccctcgtgcagaccgacgcggacgtcgacacccgagtcacgcagcgacagcgcgtgggcgtggccctggctgccgtagccgatgaccgcgaccttgcggccctggatgatggacaggtcggcgtcggcgtcgtagaacagctcggccactttgggttctctccttggtgtgcaggtgatgcgtcccaccgtatgccggtgaggtgacgggaagtttcggggtctcggaatgcgggcggccgacgactgacgaccgcccgtttccagacttacgcggatcggtccagcgcgcgcagcgagcggtccgtgatcgaacgtgccccacgtccgatcgcgatcgttccggactggacgagctccttgatgccgaacggctccagcatcttgagcatggcctccagcttgtcgctgccgccggtggcctcgatggtgacggcctccggggagacgtccacggtcttggcgcggaacagctggacgatctcgacgatctgggagcgcgtctcgttgtcggcgcgcaccttcaccagaacgagttcgcgctgcacggccgcggacggctccagctcgacgatcttcaggacgttgacgagcttgttgagctgtttggtgacctgttcgagcggcagtgcctcgatcacgttcaccacgatggtgatgcgggagatgtcggggtgctcggtgacaccgacggcgagcgagtcgatgttgaagccgcgccgggagaacagggcggtgatccgggcgaggacaccgggcttgttctcgacgaggacggagagggtgtgcttgctcatggttctgactcggctctctctcagtcgtcttcgttgtcgccgaagtcggggcggacgtcccgggcgaacatgacctcgtcgttggaggtgcctgcggcgaccatcggccagaccatcgcgtcctcgtggacgatgaagtcgatcacgacggggcggtcgttgacggagttcgcctccgcgatgaccttgtcgaggtcgtccggggactcgcagcggatcgcgtagcagcccatggcctccgacagcttcacgaagtcggggacgcgggtgccggcgctcggctgctttccgtccgcgcccgggccgctgtgcagcacggtgttggagtagcgctggttgtagaagagggtctgccactggcggaccatcccgagggcgccgttgttgatgatggcgaccttgatcgggatgttgttcagggcgcaggtggtgagctcctgattggtcatctggaagcagccgtcgccgtcgatcgcccagaccgtacggtccggctgaccggccttggcgcccatcgcggccgggaccgcgtagcccatcgttccggcgccgccggagttcagccaggtcgcgggctgctcgtacttgacgtagtgcgcggcccacatctggtgctggccgacgcccgccgcgaagatcgtgccctccggggcgagctgcccgatgcgctcgatgacctgctgcggcgacagcgagccgttgtccggctgctcgtagcccagcgggtacgtgtcgcgccagcggttcaggtccttccaccaggcggtgtagtcgccggcgtggccctcgctgtgctccttctgcacggcctggaccaggtcggcgatgacctcgcgggcatctccgacgatcggcacgtccgcggcgcggttcttgccgatctcggccgggtcgatgtcggcgtgcacgatcttggcgtacggggcgaagctgtccagcttgccggtgacgcggtcgtcgaagcgggctccgagggcgacgatcaggtcggccttctgcagcgcggtgacggcggtgaccgcaccgtgcatgcccggcattcccacgtgcagcttgtggctgtcggggaatgcgccgagcgccatcagggtggtggtgacgggcgctccggtgagttctgcgaggaccttcagctcggcggtggccttggccttgaggacgccgccgccgacgtagaggacgggccgcttggcctgggtgatcagcttggcggcctcgcggatctgcttggcgtgcggcttggtcaccgggcggtagccgggcaggtccggggtgggcggccactggaaggtggtctgcgcctggagggcgtccttggcgatgtcgacgaggaccgggcccggacggccggtggaggcgatgtggaaggcctccgcgatcgtccgcgggatgtcctcggccttggtcaccaggaagttgtgcttggtgatcggcatggtgataccgacgatgtccgcctcctggaaggcgtccgtaccgatcgccttggacgcgacctgcccggtgatcgccacgagcggcaccgagtccatgtgggcgtcggcgatcggggtcaccaggttggtggcacccgggccgctggtggccatgcacacgccgaccttgccggtggcctgcgcgtagccggtggccgcgtgacccgcgccctgctcgtgccggacgagcacgtgccgcacgcgcttcgagtccatcagcgggtcgtaggccgggaggatcgcgccgccggggataccgaataccgtctccgccccgacctcctcgagcgagcggatgagggactgcgcgcccgtgacgtgctcgggggcggactgctgtcctccggaacggggccgcggctgcggatggtgggccccggtggcctgctcggtcatcggcattctcttctcgatgctgagggtttttgcgaggtttgtacggtgttgaactggtgcctgtgcaacaaaaaacccctcgtgccgtgaggcaagcgaggggagcgcgccgggtgcggtcgctgggtgttccgggtcgtccggtacttcaccagctcagccgacgcgctttccaagtacgagaattcgggtgcgcatggcattgaccctccccccggcacgcaccgactgtcaagtgggtgggacgggagtctcattatgtgagcggagggccgtaccgccaccgaacacgaccggcacaccaggcgtgtacaccccggcacccccgcccgcgaaggcgggctcggccggtccgtggggcaccgggtactgcccggtggccagggcccggcgcagccggtactcgtcgagcgggccggagaaggccgtgccctgcccgtgcgtgcagcccatcgcacggagagcgagcacctgctcgggcaggtccaccccgtcggccacggactgcagcccgaggtcgctggcgatgcgcagcagcccgctggtgatcttgtgcagccgcgcggactccaccacgccctcgacgaggccacggtccagtttcagtacgtccacggggagcctgcgcagggccgtgatggccgcgtagccgctgccgaagccgtccagggcgatccggacgccgatccgccgcagcgcgctcagcctgcgctccagctcgtccagggagacccgtgggtcggtgtcggacagctcgatcaccagggcgcccgaggcgagcccgtgccgggtcagcagggcctccacggagccgaggggcagggagcggtccagcagacggcgggcgctcatccggacgccgacgggtacggcgaggccggtggcggtgcgctcggcggcctgctcgacggcctcctcgaggatccagcggcccagctcggcggccttgtcgctgtcctcggacacgcgcaggaactcggcgggcgtgaagagcacgccctgggaggaacgccagcgcgcctgggcggtgaccgaggtgatccggccgtcctccagcgacaccacgggctggtgcagcagcgcgaactcgccgtcgtgcagagcggcgcgcagccgggtggccagctccgccttccgtacgacgtcctgctgcatctgtggcgcgtacagctcgacgcggcccttgccggcggccttggcccggtacatggcgaggtcggcgttgcgcagcaggtcaccggcgccgaggcccggctcggcgaaggccacgccgatggacgcggcgacccggacatcgttgccgccgatggcgtacggctgcgagagggtgaccctcagccggtcggcgagctccatgatgtggccttcgcgggcggtgcggtcgcgggtgccgtcgccgacgatgagggccgcgaactcgtcgccgccgagccgcgaggcggtgtccccgtaccggaccgcgtcctggagtctgcgggcggcctggacgaggagctcgtcgccggcctggtgcccgatcgtgtcgttgaccgccttgaagccgtcgaggtcgatgaagaggacggccgtgccgcggtcggaggtgcggcggccggaaagcgcctgctggacgcgcttggtgaacagggcgcggttgggcaggtcggtgagcgggtcgtgctccgcgttgtgctgcagctgcgcttgcaggcgcaccctttcggtcacgtcccggctgttgaagatgagaccgccgtggtgccggttgacggtcgactcgacgttcagccagccgccgtagccggacttgaagcggcactcgatgcgggtggtgggttcctcggtgtggctggcggcgaggaagcggcgcacctcgtgcaccacgcagcgcaggtcctccgggtggatgagcgaggcgagctcggtcccgacgaggtcctcggcgggccgcccgtacacgcccgcggcggccggggagacgtaccggaggatgccgttgggcgcggcgatcatgatcacgtcgctggagccctgcaccagggagcggaagtggttctccttctgggccagctcctgggtgagggtgatgttgtcgagcagcatgatgccctggcgcacgacgagggcgagcacgacggcgcccgcggtgatgagcaccactcggtcgacgttgcggccgttgagcatgttgtagaggatcccgagcgtgcagacggcggcggcgagatacggcgtgagggcgcccagcgatccggcgatcgggcgggtggccggataccggctgtgacctccgtcctggaggggtgcgcgcggccggtcgcccgggtggcccggtgggcgaggccccgcaggccgtgagcccgccggccgtggccccggcacgtgctcgtgcaccacgcgtgcgtgcccgctctcccgctgcccgaaccggacgccgacccagggggcgtacgcgaggagcagcgagccggcgaaccagccggcgtcgaggagctggcccgagcggtagttgtcgtgcagcaggggcgaggtgaacagggcgtcgcacatcacggtcagggccagcgcgccgatcgcggtgttcaccgcggagcggttgaccgccgagcgcctgaagtgcagggcgagaaccatgctgaccagggcgatgtcgagcagtggatacgcgagcgagagcgccgtgtgcgcgacgctcggcccgtcgaacttcgccgcctgggcgagtgcgaggctccaggagagcgtgagcagcgagccgccgatcagccaggcgtccaggacgagacacacccaacctgctttggtcacgggccgtttggcgagcaccagcagccccacgatggcgggcggcgcgaagcagaggaagaacaggtcggcgtagctggggctgggcacggggtggtggagaatcacctcgtaccacccccaaaccccgttgcccagtgacgccatggcggaggagagcgcgaacagcagccatgcgagtcggaagcggctgcgacgcgtgcgcgcatagaggaggcaggagaccgccgcggtacccgccgcggcgctcagcccgaagtcgcccatgacgagtgcgaccctctgggagccccagccgagcgcggaaccgagggcgtatcccgcgcacaccagggccagtacgagttgcgggaccaggctcgtcccgccgccgagtgccggctggcggacaagcagcgccccgggggagctcaccgggcccaccgggcccgggccgctgcggggtcccgcaggtccggcgccggctgtgcgtgccgcttgcgaccgccgggcctgcgctggtgatggccaccgaggccgcgtctgcgcgccgccgcacaccagggtcgccgtcggccgccccgccgcgtcggatcgttggtccatggaccgtgcatcatccgtcgcccccctcgcagtctgaaatgtccatccccggcgccgaatggtgcgcggcgcagcccctgtcgggacgatacaccagtctcgtcactcagggacatagcttctctacgctccgtgacgatcaacgggggaacggaaactgcccgcatccagggaactgcggagggtgcccgaagtggacgggaggccaaccggacaccaacgggaggtgacttacgcacccgtggtgagaaccaggttgtccagcggttctccgcgcgcgaaacggttcagctgcgccaccaggagccgcttggcgcgcggcaggaacgcggaggtggggccgccggtgtgggggctgatgagcacccccggcgcatgccacaacgggtgccccgccggcagcggttcggggtcggtgacgtcaagtgccgcctggatgcggccgctctccagctcggtcagcagcgcctcggtgtcgacgacgcccccgcgggcgacgttgaccagcagcgcaccgtccttcatccgggccaggaagtccgcgttgaccaggcctttcgtctgttctgtgaggggcgtgacgaccaccaccacatcggcgtccaaaagaagttcaggcaatcgggagatgggatgcacggggccgcgcgccgtctcgcgtcccgagcgcgcgacgcgcgccacccgcgcgagctcgaacggcgcgagccggtcctcgatcgcgctgccgaccgagccgtacccgacgatcagaacggacttgtcggcgagcgccggacggaacccggagcgccactcctcccggtcctgtccccgtacgaagtcggggatgccccggagggaggcgaggatcagcgtcagtgtgagctccgcggtgctggcgtcgtgcaccccacgcgcgttgcacagctgcacgccctcgggcagcagtccgaggccgggctggatgtggtcgatgccggcggagagcgtctgtacgacgcgtacggacgtcatctccggcagggggcgcagcgcgatctcggcgcccttcatgtagggcacgacatagaacgcgcagtcggcggggtccgcggggaactccttgccgccgtcccagaagcggtaggtgaggtcctcggggaggccgtcgatctcctccgcgcgaagcgggagccatacgtcggaagtcatggtcaggaggctatgcgaagcgtccggcaccgcattggttagtttggggtgccaggagagggagggttcggccacgtggagcgcaggactatcggcgcggcgacgctcgatgtgggggccgtcggactcggatgcatgccgatgaactgggcgtacaccggttcgcggcagcggggcgacgagtcgctgcggaccgtgcaccgggcgctcgacgtgggcgtgacgctgctcgacaccgccgacatgtacggcccgttcaccaatgagctgctggtggggcgggtgctgaaggagcgccgctccgaggccttcgtgtcgaccaaggtgggcctgctggtgggcgaccagcacatcgtggccaatgggcgccccggctatgtgaagcgggcgtgcgacgcctcgctgcgccgcctccagacggacgtgatcgacctctaccagctgcaccgcgcggacccggagattccggtcgaggagacatggggtgcgatggcggacctcgtccgggccgggaaggtacgggcgttggggctgtgcgcggtgggcgcgcgttccgcccgccgctccggggcacggctgcacgacgccacgatccggcagctggagcgggtgcagcaggtgttcccggtgagcgcggtggaggccgagctgtcggtgtggtcgaaggaggcactggacgcgctgctgccgtggtgcgcggcgcgcggggtcggcctgctggccgcgatgccgctcggcaacggcttcctgaccggcacgctcacgcccggcgagggcttcgagccggacgacctgcgggcccggcacccccgcttcacggcggagatgatggccgcgaaccagccgatcgtggtgggccttcggcgcatcgcccggcggcacggggacgaggtcacacccgcgcaggtggcgctggcgtggctgctggcgcagggcccgcacgtggtgccggtgccgggggcgaagcgggcacggtgggtggccgagaacgcgaccgcggccgggctgcgcctgacggcaagggacctggcggacgtggcggccctgcccgcggcacgggggtcctgggactgagtgcgggtccgcggcccgggtgccggggccgacgggtccgcgacgcgggggcccggaacggaatggtgggggccggccgcctgggactcggatccggccgcctcgggcgcgaccggcccggtgcggagcggcatgatccggccgcctcggacgcggcgggccggggcccggccgtggtgggttccgggattcggggccggcgatcgggaacccaggaggcgcgtgcggtgtaagacaggtagaagccccacgtcgaagggaccacgatcgtgcaacgtcgagctgcggcggccgtactggccgcggcctccctcctgctggcgtccggctgttcctccggcgacggaggaaccccgggcgcggacaggagcacctcaccgggccgtacggcgccggggtcgtcgtcctccgggaagacggcggaggcaaccccgcccgcgaagggctcggtgaaggtggtgcgcacggtcgcccagggtctgaagaccccctggggcctcgccccgctgcccgacggcgatctgctcgtcacctcccgggacgacgggacgatcacgcggatcgacgagaagaccggcaagaagacggagttgggctcggtgccgggcgtctccgccgccggcgagggcggcctcctgggcatcgccctctccccgtcgtacgcctcggaccacatgatctacgcgtacttcacgacggcgtcggacaaccgcatcgcccgcctgctgcacgaggagcacaagccgtcgggcgagcagctgggggcaccggacacggtcttcaagggcatccccaaggggttcatccacaacggtggccggatcgcgttcggcccggacaacatgctctacgcgggcacgggtgagtcgggcaaccgcggcctggcccaggacaagaagtccctgggcggaaagatcctccgcatgacgccggagggcgaaccggcgcccggcaaccccttcggtgactcggtcgtgtactcgtacggccaccgcaatgtccagggcctggcctgggacgacaaacaacgcctgttcgccgcggagttcggccaggacacatgggacgagctgaacgcgatcaagccgggcggcaactacggctggccggacgccgagggcaggtcaggcgacgcgaagtaccgcgacccgatagcccagtggcacaccgccgaggcctcccccagcggcatcgcctacgccgagggctccctctggatggcgggcctgcgcggtcagcgcctgtggcgggtcccgctgaagggcaccgaggcctcggcggccccccaggccttcctgaagggcacctacggccgactgcgcacggtggtcccggcgggcgacggcaagctgtgggtgacgacgagcgagacggacggccggggcacaccggggaagggggacgaccggatcctggagctgcaggtgacgtaggaaaggctcgcgggcctcagtcctcaccgggctccggggcggcggcgggctccggggccgcgggcggctccggagccgcggggggctgcttcggcgggcgtacgacgaccttgcccgaggacaggtctatgggccctcttccggggtcgccgtcgttcacatccgttcggctgagttccaggcgctttctctcgtcattggtgtgcttacggcctggtgcgaagagttcctcgaacatgttgaacacagggcctccctcggccgggatccgttccagcgtatgtctcaccccgccgccggggcagcgggtgcctcgggcgggaacaaccgcatccgatgcgccagcgccgccgcctccccccgccccgcgacgcccagcttggccaggatgttggagacgtggacactcgccgtcttgggggagatgaacagtttctcggcgatctggcggttgctgcggccggcggcgaccaggcgcagcacgtcgcgctcccggctggtcagcccgagcgcctcggccgggtcggcgggcgggctctgccgcgtcgtcccggacagggtgagccgggcgcgctgggcgagcagggcgaccgattcggcgagcgggcgggcgccgaggtggtcggccaccgccccggccaggcgcagcagttccgtggcgcgggcgcgggcgtcgtcgtccgcgccggaggccagcagggactcggcgaggcggtggcggacgcgggcgaggtcgtaggggcgctccagcggttcgaaggcggtgaccgtctcggaccagtcccgtggggtcccggcgccctcggcgcgcagcagctcggcgcgcagccagtgcccgtaggcctgccagacgggcacgttcgtggcgagtgtcttggcggccttgtggatgtcttcgagaacctcgccacgccccggctcggcgccgggcaggccgagggcgtccgcctccgcggtggcggcggccagcagcagcggccagccgtagcgctgggttccgggcgggaagccggtgtccagcgcggcggcgagttcggcccgggcatccaggaggcggccctccgccgcggcgacgccgatcgcgatgcggccgagcggcagggcgtgctggggcatggtgtcgtgggtgccgaagtgttcgcgggcggcggtcagttggcggcgggccacggtcaggtcgccgcgggagagggcgaaatgggcgtgcagcgtggcgtggaagccgcggcgttttgcgctctggccgacgcgctccgagctgatcgcggcttcaccggcctcgtcccagcgaccgagggagtgcagggattcggcgaggttgccccacaccagggcctcgatgtccagcagaccgagccgcctggcgaggccgacgccttccttgaggacgcggacggcttcctgggagcggccgatgccttccaggtgggacggcaggttcacatggaggcggcccagcacggcggcgtcgccgagcgcctttgcctgttccttgacctcgtgcagctcggtgagccccgcctcgatgtcgcccgcttcgacgaggagcccgcccagggtgagccgcgcgttcagctcgatgtcccgggcgcccaccatgcgcgcgtactccacggcgcgctcggcggccatgagcgcgtcgggtcccggctcgtgcaccatcgaccagttggcgacggtggcgagcacctcggcgtgcacctccgagggcggtaggccccggaccagttcctgggcggtggccagctccttccagccgtcgccgcgggccgtggtctgcaccagccgggaacgctgggcccagaaccaggcggcgcgaagggggtccccacggcccgagccggacggcgagttcgggtggtgatcgtcctcgtcctccaggaggcgcagggcccgcctggtgatcttcagcgcgcgttcgcgttccccgcacaggcggcccgcgacggcggcctcggccatcaggtcgaggtagcgcaggggggtggtggccgggtcgcagccgcagggcggatagacctcggcgtagtcgacggggcgcaggccggcccgtatcgagtcgggggccaactcccacagctccatcgcccgctccaggagccgcagttgctcggcgtgtgcgtgccggcagcgggcctcgacggaggcgtcgaggacggcgggcagcgccttggccgcgtcgtgggcgtggtaccagtagctggccaggcgagcggcgcgctcgtcggccggtacgagtgcgggatcggcctccagggcctcggcgtaacgcctgttgaggcgggagcgctcgccgggcagcaggtcgtcgctgacggcctcgcggaccagggagtggcggaagcggtagccgtcgccgccgggtgcggcgatgaggatgttggcgccgacggcggcacgcagcgcctcgatgaggtcgtcctcggcgagccgggccacggcggccagcagccggtactcgacggtggaaccgccctcggcgacgatccgggcgacccgctgcgagctctcgggcagcccctcgacgcgtacgaggaggaggtcgcggagggagtcggtgaggccggtgcagcagccctcgtgggcggcgacggcgagttcctccacgaagaaggcgttgccgtcggagcgttcgaagatgtcgtcgacctgggcggggtcgggttccgcggcgaggatgccggcgatctggcggccgacctcggtgcggttgaaacgggcgagttcgatgcggcggacggtgcgcaggcggtcgagttcggccaggagggggcgcagggggtggcggcggtggatgtcgtctgcgcggtaggtggcgacgacggccaggcggccgctgcgcagggtgcggaagaggtaggcgaggagatggcgggtggaggcgtcggcccagtgcaggtcctccaggaggacgaccaccgtgcggtcggcggcgaggcgctccaggaggcgggcggtgagttcgaagaggcgggccgttccctcctcgtcgtcccgggggccgcgcctggcctcgcccagctcgggcagcaggcgggccagctccgcctcctggcccgcggccgcggcggcgagttcgtccgggagctgtctgcgcagggcgcgcagggcggtggagaacggggcgaacggcagcccgtcggcgccgatctcgacgcagccgccgaccgccacgacggcgccggtacggccggccgcggtggcgaactcctcgatcagccgtgtcttgccgaccccggcctcaccgccgagcagcaacgcctgcggctcgcccgcggcggcacgggtgagcgcgtcggcgagtgcgcccaactctgcggcgcggccgacgaacacgggactgacggacctggtctccacggtcccgagcatcgcacgggggtcggacaacggggcagcgaatatcggcgggcgggcggcaacggccggtgcgccaccgacaccgaggccggcgaggacggcggacgcgtcgccgatgccgacgacggcagacgcgccaccggtgccgacgacggcagacgcgtcgatgccggcggcggcccggacggccggcaccgacatcgacggggcggtgtcccccgacggcgcccccgcccgggaccggccgacccccgtacggccggtccccctgcggctgtcctcccgggacccgccggtcccggtacggccgtcctcccgaggtcggccgatccccgtacggccgtcctctcggagccccgggcccgcgccgcccggcggctcccccgcgctcgtgttcacgcggcgcgggcgaaccgcggccggcggggacggttgctatgggacgtggactgtccctccgtgtcgggttccccggcggcggccttgcgggcgtcgcgggcgtcgcggcgcaggcggagggcctcgcggacgagacggtggttctgcgcctcgcggatcaggtcggcggaacggatctggtggagctcgtactcgaacatctcgtgtccctcgtgaagagtcggtttccggcttcgcttgttgcgatgcctcaactttcgtctccaaggcgggtgtgccacatcgggagagttccgcatcttgcacgcgcgaggggccttagatccgccgtgggtgtcctacggcggacctaaggcccctcagaacgcgctaagtacgtgctccggccctgctcgggaggatcaactcgccgacggcaggcccaggatgatgtcggtgtacttcgcgaccgcgagcagcagaccgatcacaccgagggcgacgccgccccaggcgaccgacttgatccacgcgggctgcggcttgccgggggcaccgaacgcgggccgggcgagcaccacgacgccgacgatcagcgcggcgagcgcgaacagcccgccgatcagcgcggtcgtggcccaggcatcgccgtagacctccttgacctgcgtggcgacggtcgccgacgacgaggtccccagctggccgaccagggtctcgcgcgcggcggccacggtggcgacccagctgccggtgagcgacacgaggccgagcccggcggagacgacggcgccggcgccctgccccacgccggaggggccctcctgggtgtccccccgaaggccgtcgacctcgtcgtcggccacctcggactcgtcggactcgtcggccgcggcctcggcgtcggtcttcgcctcggtggcctcggtggtctcggtggacttttcgaccttggtggtgtccacctttgcctcgtcgctcttcgcctcggtgccggtctctgccccggcctcgtcaactgtcttggttcccatgtctggcaccgtacggacgctctctgagaggtttcttaatgatcgttgtgagtggtacgcgcgcgtgccgcccgccactcgggcgcgagcaccgaccacacctcggtgtcctggcgcacgccccggtggacggagttcccccgaagcacgccgtcgcggctcatgcccagtcgccgcgccaccttgatgctcggttcgttggcggacgacgcccgccactccacacggtggatgccgcgcccgtcaaccgcccagtcgatgagcacccgcatcgcgcgggtgacgagcccccgcccgctcccggcgggttccagccagcagccgacctcacaggtgccgttcacggcgtcgaagacgcggaagagcacgccgccgacgagcttcccgtccagccacagtccgtgcaggccgccgttgtcggtggcgcgtttgtcggcccaggtccgcaggacggcccgcgcggagtcgacgtccgtcgcgcccaccccgaacgggatgtgccgcgtgatgaactcgcgcccgcggtcgaggtgcgccagaaactcctcggcgtgccagggttccagcggacgcagttcggcgccgtcgtcacccagcgatatcgcgtacatcccgctgccgctccttcatcagtacgtccgccggcgcgtcgccggcgcacacgccgtccgcgtcggacatgtcggccgcgtcagcccctcgttgtccccgcgtcgtcccggaatggtcccacgggacgcgtgggcggccccggcgtgcgcccggttcggtgccgcggcgccgcaggcacctgtcgaggcggcgcgccggccgccggtcggcgcgccgggcagatccatgagggcggggcgccaggagggtgcgcactcagtcgtccccgtggggcgtccgggggcatacctggggggtgcatcggaaccgatgcaccccccagggcttgcaaaaaggcggaactcagccctcgctgacgccgagcttctccaggatcagctccttgacgcgggccgcgtcggcctggccacgggtggccttcatgacggcgccgaccagggcgccggccgcggccaccttgccgccgcggatcttgtccgcgacgcccgggttgcccgcgatggcctcgtcgacggcggcggtcagggcgccctcgtcggagacgaccttcagaccgcgcttctcgacgacctcgtccggagtgccctcgcccgcgaggacgccctcgatgacctggcgggccagcttgtcgttgagctctccggcgacgacgagctgtgccacccgggcgacctgcgccggggtgatgggcaggtcctccagggccttgcccgactcgttggcgctgcgggccagttcgcccatccaccacttgcgggcggacgccgcgtcggcaccggcctcgatcgtggcgacgatcgggtcgatggcaccggcgttgaggatcgactgcatgtcgtgggcgttgacgccccactcctcgcgcagccggttacgacgcgccagcggctgctcgggcaggcccgcgcgcagctcctcgacccacgcgcgggacggggcgacggggacgaggtcgggctccgggaagtaccggtagtcctcggcctcctccttcacccggcccgaggtcgtggaccccgtgtcctcgtggaagtggcgggtctcctggatgatcgtgccgccggagttcagcaccgcggcgtgccgctggatctcgaaccgggccgcacgctccacggagcgcagggagttgacgttcttcgtctcggagcgcgtgccgaacttctcccggccgtgcgggcgcagggagaggttcacgtcgcagcgcatctgccccatctccatgcgggcctccgacacaccgagcgcccggatgagctcgcgcagctcggcgacgtacgccttggcgacctcgggagcacgctctcccgcaccctcgatcggcttggtgacgatctcgatgagggggatgcccgcgcggttgtagtcgagcagggagtgcgaggcgccgtggatacggccggtcgcgccaccgacgtgcgtcgacttgccggtgtcctcctccatgtgggcacgctcgatctccacccggaagacctcgccgtcctccagctgcacgtcgagatagccgttgaaggcgatcggctcgtcgtactgggaggtctggaagttcttcggcatgtccggatagaagtagttcttccgggcgaagcggcaccactcggcgatctcgcagtgcagcgcgagaccgatcttgatggcggactcgacgccgatcgcgttgacgaccggcagtgcgccgggcatgccgaggcaggtcgggcaggtctgcgagttgggctcggcgcccagctcggtggaacacccgcagaacatcttggtcttggtgccgagttcgacatggacctcgaggcccatgacggggtcgtacgacgccagggcgtcctcgtacgacaccagctcgtcggtcgtggtggtcacggtgaaaacttccctctcagcccagcaggacgtcgtcgtcgcccaggcgcttgagctcccggtagaggatggcgaggccggtgacgatggcggcggcggacacggccgcgtcgatgaggcgcagcgtgtcgctctcgaggcgggccttcttggcctgcttggcgaccccgatcacaccgaacgcggtggtcgcgatggacaggtacgtaccggacttggacttcttgaagcccttggccttggtcagtgcggtgctcacagcgacggtgcctcctcgatcagcgggtgcccccacttttccacgaaggcggcctcgacggcggcgccgaccttgtacagcctgtcgtccttgagcgccggggcgatgatctgcaggccgaccgggaggttgtcctcgggcgcgagaccgcagggcagcgacatggcggcgttgcccgcgaggttggtcgggatggtgcacaggtccgcgaggtacatcgccatcgggtcgtcggcgcgctcgccgatcgggaaggcggtggtgggcgtggtcggggagacgatcacatccacctgctcgaacgacttctcgaagtcgcgggtgatgagcgtacggaccttctgggcgctgccgtagtacgcgtcgtagtagccggagctgagcgcgtacgtgccgagcatgatgcggcgcttgacctcgtcgccgaagcccgcctcgcgggtgagggcggtgacctcctcggcggagcgcgtcccgtcgtcacccacgcgcacgccatagcgcaggccgtcgaagcgcgcgaggttggaggagcactcggacggcgcgatcaggtagtacgccgacagggcgaggtcgaaggacgggcagtccagctcgacgatctcggcgcccagctccttgaggagggcgacggactcgtcgaagcgctggagcacaccggcctggtagccctcgccgcggaactgcttgacgacgccgacgcgcatgccctcgacgctgccgttgcgggcggcctcgacgaccggcgggaccggggcgtcgatggacgtcgagtcgagcgggtcgtgcccggcgatgacctcgtgcagcagggccgcgtccaggaccgtacgggcacaggggccgccctggtcgagggaggacgagaacgccaccatgccgtagcgggagaccgcgccgtacgtcggcttcacgccgaccgtgccggtgacggcggccggctggcggatggagccgccggtgtcggtgccgatggcgaggggggcctcgaaggaggcgagggcggcggaggagccaccgccggagccaccggggatacggctgaggtcccaggggttgccggtggggccgtacgcgctgttctcggtggaggaccccatggcgaactcgtccatgttggtcttgccgaggatgacgacgtcggcggccttcagcttcttggtgagggtcgcgtcgtagggcgggatccagccctcgaggatcttcgaaccgacggtggtcgggatgccctcggtggtgaagatgtccttgagcgcgagcgggacgccggccagcgggccgagcttctcgccgcgctcgcgcttctcgtcgacggcgcgggcctgggccagcgcgccctcgcggtcgacgtgcaggaaggcgtgcaccttctcgtcgacggcgtcgatgcgggcgaggtgggcctcggtgacctggacggccgtgagctcgccggaggcgaccttcgcggcgatctcggcggcggtgagcctgatgatgttgacgttggtgtccgtcatggtgattagtcctcccccaggatctgcggcaccttgaaacgctgctgctcctgggccggggcgccggagagcgcctgctcgggggtgagcgacggacggacctcgtccgcgcgcatgacgttcgtcagcggcagcgggtgagaggtcggcggtacgtcttggtcggcgacctcgctgacgcgggcgaccgcgccgatgatgtcgtcgagctggccggcgaagtggtcgagctcttccgccttcagctccagacgcgccagccgtgcgaggtgggcgacctcctcgcgcgtgatgccaggcatgcagcgatcctctggggtgagagtgtgtggtttgggcccaatcctatggggcggccgcgggtgcccgcgcacgggcttgtccgggccctctcaccgatccggcggacgggcggctcgcgggcgacgggcaacgcccacgggaatgcccacgggaatgcccacgcggtcagcggaacgtcactggcggttccggcgatgcgaacgtcacgcgccgtacggacgggtacgggcgtacagacgatgcaggcggtacggacgtcacgggccgtacggacgggtacgggccgtacagacggcgcggacgggagaactattcgtccgtcgccgccgcgggcaacgccgccgtcggccgctgccacccccgcgatccccgcgcccgcagccacgccgtcgcctcgtccgccggcatcgccgcggccaccagccagccctggacggcgtcgcagcccaggtcccgcaaccgctcccatgtctcgtcgtcctcgacgccctccgcgacgaccagcagccccagcgaatgggcgagatccaccgtgcagcgcacgatcgccgcgtcctgcgtgtcgacggccagccgggccacgaacgaccggtcgatcttcagctcgctgaccggcagccgccgcaggtgcacgagcgaggagtaccccgtgccgaagtcgtccagcgacatcttcaccccgtgcccggtgagcccggcgagcgtgtccgccgcccgctgcgggtcctccaggagcacgtgttccgttatctccagctgcagcgcccccgccggaaccccgtgccgggccagccgggccgccaccgaacccgcgaagccgggggtgtggacgtcacgcggcgagacgttcacggccaccggcacccgcagaccctgcgcccgccagcgcgccacctgcccgagcgccgtctccagcacgtactccgtcagatgcggcatcagccccgacgactcggcgatggcgatgaactcgtccggcggcaccttgccgcgctcggggtgcacccaccgcacgagcgcctccagaccggcgacctgcccgtcgaagcgcaccttcggctggtagtgcagctccacgtcgccggcgtccagcgcccggcgcaggtctcccagcaggccgagccggtccggtgtgttcgagtcccgcttggactcgtacacctccacccccgtacggtcccgcttcgcctggtacatcgcgacgtccgcgcgttgcagcagcccctccgcgtccagtgcgtggtcggggaagacggcgagcccggcgctggcctccaggacgagcgtgagcccgtcgaggtcgagcggcgagccgagggctgcgaccaggttgcgggcgacccgggtggcggacgtcgtggagtccgcgacgggaagtaacacggcgaactcgtcacccccgagccgcgcggcctccgctccgcgcggcagggcgagccgcagccggtcggctatctgcagcagcagccggtcgccggcgaggtgaccgagcgtgtcgttcaccgcccggaagcggtcgaggtctatcagcagcagggcggagcgcgccccgatgcgttcggcgtcgtccagcgccgtccaggtccgctccagcagccactgccggttgggcagcccggtcagcgggtcgcgcagttgttcctccgcccgggcccgggctatccacagggtggagtcgagggcgatgagggggatggcgaagagcggcagcaggagcgggagcgcgtcggcgacgacgcagatcagcggcgcgatgccgagcagcgcgaccgcgaggagtccctgtctgaccagggcggtgcgggcgaccgtgggcacaccgccggtgcgcggcgtgtgcacgtaccagaccagtgtgcgggtcaccgcgagataggcgaccgcgaccagcgccagctcgggcacggtgtagacggtccagctctgggggtcccagggcgtctcgacggacggcacgcgcccgaacgcggccagcaccagcgcacccgcgccgatgccgaggaggtcgaccgagccgtgcagcacgccccctcgccagcggtcgcgtcgggctatgccgacgaggacgacgacggtgaggctgaccatcccggccggcacccagccgtacagcagcaggacggcgagggtgagggcggcaccggagcccgtgccgccccaccagcgggcgcggccgagcgcgaccaggtggccgacgatgacgccggtgagcacggccagggaccagccgacggtgccggacgggaagagcgcgtggttccaggtgaacgcccggtagaagccggcgccgagcacgaagcccgccgtcgcgacgacggccgcgggcagcgcgggccaggacaggtgtcgctcggagtcggggccggacgtcccggggccctgcccggcgcccagcgctccgctgccgggggcggcggtgagcggcatgacgccgggggcgttcccccgcgccggtccgcgtccgtccacgcccgcgagccccgaagtgcgcgccacgcggcggattccgccgggctcccggctgcctccccacacgcggctccgttcgaccggggcgacccctgtgggccgccgagacccccatcgccatgcgccggacctccggcgcagccgtgagtccggggcggcgctctcggtcggttccattcccgtccctctcacagccggcagtgcccacgcgacgcggcccgagtccattcaactgccgtcaactgccaacggcaccgcgtctgaaaacccaccacgcgtccgggcacggcaggcgcacacctcaacagtaggccgcagaaggcttccacgggcagcggtcgtcgacggttgcccgaatgcgacccggccacccgtatgcatctggtatgcgccgaacgggtggccttcaaccgctactcctcggtcggaagtgcgacttccgcagcggcttccggtccttgctcgagcagaacggcgaatccggcctcgttcagaacgggaaccttcagctgcatcgccttgtcgtatttcgatccaggattgtcacctacgacaacgaaagacgtcttcttcgaaaccgaaccggtgactttcgccccgcggctctgcagggcctccttcgcgccgtcccgcgtgtggtgttcgagcgttccggtgacgacgaccgtgagtccttcgagcgggcgcggcccctcgtcctctccggagcgctcgtcctccatgcggacgccggcggccttccactttcggatgatctcccggtgccagtcctcggcgaaccactgcttgaccgcggcggcgacgatcgggccgacaccgtcggtgtccttcagctcctcctcggtggcctggtcgatgcggtcgatcgagcggaacgcgcgcgccagcgcctcggccgcgaccggcccgacgtggcggatcgacagaccggtcaggatccgggcgagcgggcgctccttggcggccgcgatgttgtccagcatcgagatcgcgttcttccgcggctcgccctgctggttggcgaagaccgtggcgaccttctcctcgcccgtcttcgggtcccgcttgggcaggccgctgtcctggtcgaggacgtacgccttgatgggcagcagccgttcgatggtgaggtcgaagaggtcgccctcgtcgagcagcggcggctcggcgggctccagcggcttggtgagggccgccgccgcgacatatccgaactgctcgatgtcgagcgacttgcggcccgcgagatagaagagccgctcccgcagctgggccggacacgtgcgcgcgttcgggcagcgcaggtcgacgtcgccctccttggccggcgccagcggcgtaccgcactcggggcactcggcgggcatcacgaacgcgcgctcggtgccgtcgcgcaggtcgacgaccgggccgaggatctccgggatgacgtcaccggccttgcgcagcaccaccgtgtccccgatgaggacgcccttggccttgacgacgtcctggttgtgcagggtggcgaactcgacctccgagcccgcgaccgtgaccggctccacctgcgcgtacggcgtgacccggcccgtacgccccacgcccacgcggatgttgatgagcttggtgttgacctcctcgggcgcgtacttccaggcgatcgcccagcgcggcgcgcgggaggtggagccgaggcggccctggagcgggatctcgtcgagcttcacgaccacgccgtcgatctcgtgctccacggagtggcggttctccccgtagtacgcgatgaactcccgtacgccgtcgaggtcgtcgaccactctggcgtaccgggtggtcggcaggccccactcgcgcagcagctcgtacgcctgggagagccggtcgatgtcgaagccctgccgggcgccgatgccgtggacgaccatgtgcagcgggcgggtcgcggtgacccgcgggtccttctggcgcagtgaacccgccgccgcgttgcgcgggttggcgaagggcttgtcgccggcctccaccagacgtgcgttgagctcctcgaacttctccatcgggaagtagacctcgccgcggatctccacgaggtccgggatgcggtcgcccttgagacggtccggaatctccgcgatcgtacggacgttgggcgtgatgtcctcgcccgtgcggccgtcgccgcgggtcgccgcgcgcgtgaggcggccgtgctcatacgtgaggttgacggcgaggccgtcgaccttcagctcgcacaggaagtggtagtcggaggtgccgacgtccttggcgacgcgctcggcccaggcggccagccccaggtcgtcgaaggcgttgtccagggagagcatgcgctcacggtgctggacggccgtgaactccgtctcgtacccgcccgcgaccttctgggtcggtgagtcgggcgtgcgcagctcggggtactcctcctccagtgcctcgagggagcgcaggagggtgtcgaactccgcgtcgctgacgacgggggcgtccttcacgtagtaccggaagcggtgctcctcgatctgctcagcgagctgcgcgtgcttctcccgtgcctcggcgggtaccgatgtgggctgtgcgtgctgttcgccggccaccgtgttgtcctcccgttactcagggttgtccgcgagtgatctcgccgcccggacgcagtgggcgagcgcctggcgcgcgtacgccggagaagcgcccgcgagcccgcacgacggagtgaccgtgaccgcctccgcgagaagccccggatgcagccccagcctgcgccacagcgtcctgacacccatgacgctaccggcagggtctgacaatgggccgtccgtccccggcacgacaccggcgagcagcttcgtccccccttccacggcttccccgatcacgtcgtcgtcacgctcggtgagcagcgagaagtcgaaggagaccgccgccgcgcccgccctgcgcaggagggcgaacgggacgtccggtgcgcaggagtgcaccacgaccggtccctccccgtgcaccccgacgacgtcccggagcgtggcctcgacggcctgccggtcgacggcccggtgggtgcggtagccgctggcgctcttcacctgcccgcgcagtacggcggtgagcgagggctcgtcgagctggagcacgagctgtgcgcccgggatgcgccgtcgcacctcttcgagatggctgcgcagcccctcggcgagcgaaccggcgagatcccggcaggcgccggggtccgacagcgccacctcgccgttcttcaactccagcgcggcggccagggtccagggccccaccgcctgcaccttgaccggcccctcgtacccctgggtgaactcctccagcgcgtcgaggtcctcccccagccaggagcgggcccgcttggtgtcccgccccggccggtccccgatccgccaaccgctgggctccacgcgcgcgtacagctcgacgagcattccggcggtgcggccgatcatgtcggcgccgggcccccgggcgggcagctcggcgaggaaggggaagtcctcgacggatccggtgacggtcttggcggtctcccgcgcgtcaccgcccggcatggagccgaccccggtggcggaaccgaacctgaactcgctgttttcactcaccccggaagcctaagcctccggcggggggggcggtttcagggtgccgccgtccgtgccggggtgcccggacggaccgacggcaccgacctgcgccgaggaaccgccgtcagtggcccggccgcaccgtcaggtcgttgacctccgcgtcccggggcaggtccagggacatcaggatcgtcgtcgcgaccgactcggggtcgatccacttcgccgcctcgtactccttgccctcctgctggtggaccttggcctgcatggggctcgcggtgcggccggggtagaccgaggtgacccggatcccgttcgcgtgctcctcctcgcgcagggcgtccgccagggccttcagaccgtgcttggaggccgcgtacgccgaccagtcggcgtgggcgttgagacccgagcccgagttcacgaacaccacctggccgtgggccaggcggagttggggcaggaagtggcgggtcagctcggcgggggcgatcaggttgacgttgagctggtggcgccaggacttcggggtcagctcgcccaccgggccgagatcgaccacgcccgcgatgtggagcagggaatccacgtggtccggcaacgtctggtgcgagaacgcccaggacagcttgtcggggtccgccaggtccccgaccagggtcttcgccccggggaacgccgccgccagttccttcgcgcggcccgcgtcgcgcgcgtggagcacgagttcgtccccgcgcgcgtgcagacggcgggtcactgccgcgccgatgccggagcccgccccggtgatcacatgtgtagccatgccggccatgctcgcatcagacggtgccgaacgactcctcgaggtaggccagcgcgcccaccggctcctcggcgaagaacaccaggtccgtgagggggcagggcaggaacccctcgtcctccatgcgccggaactgctccttcaggccgtcgtagaagcccgcggtgttcagcagcaccacgggcttgtcggtgtgaccgtgcttcttcagctccaggatctccgtcgcctcgtccagcgtcccggtcccgccgaccatgatcacaacggcgtcggcccgttccaggagcagcgccttgcgctccgcgaggtcacgggcgatgaccatctcgtcggcgcctgcgcgggccttggcggcgaggaagtccacggagaccccgaggagccggccgcccgcctcctgcacaccgtcggcgaccaccttcatgagaccgacgtcggagccgccccacaccagtgtgtgcccgcccttgccgagcagttccgcgaactcccgcgcggggcgcgtgtagcggtcgtcgaggtcggcggcggagaggaagacgcagattttcatggttttaccgtacgcgggaagaaccccggccccgcgagcgctttcgcgggtatggctgaaggacacacgatcacgatcgagcagggcaccgagcgcgtccgcgtggtgcacggcgaccaggtcctggcggagagcgaccggcccctgctgctgcgggagacgggctgccccgtgcgctactacctcccgccggaggacgtacgcctggacctgctgaagccctcggagacccacacgcactgccccttcaagggcacggcctcgtactggtccctgccggacgcggcggacctggtgtgggcctacccggaacccaagccggacgtcgcgcagatcaaggaccatctctgcttctacgaagtcgaagtggcctgacgaagtcgaagtggcctgacgtgcgcgcacgcacgcctggcacgcgtcccggggcgcacgcacgcgtggccgcgtcccggggcgcacgcacgcgtggcacgcgcctcgggccgcccgtctgcgtaggcgtgcggatgcgtgcttacgccaccgcggtcgccgtccgcgtcgtcgtcgcgatcgtcgccgagcccaccacgcgcgtgccgtcgtacagcacgaccgcctggccgggggcgacgccgcggaccggctccgcgaaggtgacctgaagctcgccgtcgaccagctcggccgtcacctgtgtctcgccgccgtgagcgcggagctgggccgtgtaggtgcccgggcccgtcggggcggcgccgcaccagcggggcttgatcgccgtcagggcggtgacgtccagggcggccgccgggcccaccgtcaccgtgttgtccaccggggagatgtccagcacgtagcgcggctttccgtcgggcgccggggtgccgatgcgcagccccttgcgctggccgatcgtgaagccgtacgcgccctcgtgggagccgacgaccgacccggactcgtcgacgatgtcgccctccgccttgcccagacggttcgccaggaagccctgggtgtcgccgtccgcgatgaagcagatgtcgtgcgagtccggcttcttggcgaccgccaggccccggcgctcggcctccgcgcggatctcgtccttcgtcgtgaccgtgtcgccgagcgggaacagcgcgtgcgcgagctggcggtcgtcgaggaccccgaggacgtacgactggtccttggccatgtcggaggcgcggtgcagctcgcgggtgccgtcctcgcggacgatcacctgtgcgtagtggcccgtgcagaccgcgtcgaagccgagcgccagcgccttgtcgagcagcgccgcgaacttgatcttctcgttgcagcgcagacacgggttcggggtgcggccggcctcgtactcggcgatgaagtcctcgaccacgtcctcgcggaagcgctcggcgaggtcccagacgtagaacgggatgccgatgacgtccgcggcgcggcgggcgtcgcgcgagtcctcgatggtgcagcagccacgcgctccggtgcggaacgactgcgggttcgcggacagcgcgaggtgcacgcccgtcacgtcgtgacctgcttccgccgcgcgggcggcggctacggcggagtccactccgcccgacatggcggcaaggacgcggaggcggcgggggcgctgcggggtctcagtcataacccctccagagtaaagggcggcgggaaccgaagcccgcgcgtatgcgttcacgatcacatgggggagacgaagggcggggacgcggaccgtcgcatcgggcgccgggccctgctgatcggcggggccgcggccgccgtgggcacggcggtgctcgcccgcgaggagctggcgcacctgtggtggcggctgcccggcgtggagaagccgcgggtggcgggcgcggtggacttccggggcgcgcagtgggtggcggcgtcctcggcgaactggcggcgggcggaccggcccgacgactacgccgtggaccgcgtggtcgtccatgtcacccagggcagcttcaagagtgcggtgaaggtcttccaggacccggggcacggcgctgccgcgcactacatcgtgcgcaaggacggccacatcacgcagatgatccgcgaactggacgtggcgttccacgcgggaaaccgggagtacaacgagcggagcgtcggcatcgagcacgagggcttcgtggagagcgcctcgtcgttcacggacgcgatgtacgaggcgtcggcgcggctgacggccgggatatgcgggcggtacggcatacccgtcgaccgcgcgcacatcatcgggcacgtggaggtgccgggcacggatcacacggaccccgggccgcactgggactgggaccggtacctgaagctcgtacggcgggctcggaccgcctgagcagcgtcgccgctgcccactcgacaccaccggcgcgaaggggcaagcgcttgccacgccggaacgcaaccctcaagagatgtgacgcagatcacgaacgccccatgttgtgagtggcctccgcgaagcgtgtgtccgatgcgtcccgcgccgtggacacgacctgcggtccgtcaacttggctttttttcaacggagttgagccatctcgcgactcagggggcctgcacagcgtgcacggccctctcctaatcacggcccagtctttacatagcccttaggtcaagcatcccgggctatgactcacaccacacagcccgcttccggagcgggcagaggcaagggcatgcaccggcggaagttcctcggcggaatggccggggccggcttcgcggcggtggcggcgggcggcgcggccctcgcgtacctgaccgacgcggggcagaaccgggcgggggcggcgagcaccacgctgaccattccggagctgctggagggcaccacgtcggacggcaccacgacgttcaccctggaggccaagaccggcaccagcgaggtgctcagcggagtgaccagcaccaccgcgggctacaaccagtcgttcctcggccccaccatgaaatggacgtccggcgacaccgtcctgctgaacatcaccaacagcctggacgcggacaccacggtccacttccacggcgcccacatcccgcccaagatggatggcggcccgcagaacgccttcgccgcgggggagacctggtcgcccaccttcaccgtcaaggacgaggccaagacgctctggtaccacccgcacgccctgggcaccaccgccgagcaggtcacgcgcggcctggccggcatgatcatcgtcgaggacgactcggacgcctcggccgccctccccagcacctacggcaccgacgacatcccgatcatcctccagtgcctggccgccgacagcagcggggacgtcaagtacgacctgaccggctatctgtccggcggcctgagctaccccctgctgtgcaacggcaccaacgtcgacgccaccacgctcgccttcaccgccaccaagtcccgcacccggttccggctgctcaacgcctcaccgtccgacatcatcaccgtgcagcgcggcgacggcgggacgctgacccagatcgccaccgaccaggggtatctgacggaggccgccgaggtggagtccatccgtctggtggcgggcgcgcgcgccgagttcgtcatggacctcagcgacgcggtgacgctccaggccgtcgtcaccacgggctgggtccgcggcggcagcggcacgtacgacttcctcaccgtcaccccggacgcctcggacacccccgacgccctgccgagcagcctcaacacgatcacccgctacgacaccaccgacttcgccgcccggaccatcacgctcggccagagcggcgcgagcatgctgatcaacggctcggccggcacgaccatggcggccatggcgatgatcagcaccaccctcgacgccgaggagatatggaccgtcaccaacagcacccagctggaacactcgttccatctgcatgatgtgccgttccagctgatctccatcaacggagaggagccgacgggcgtcgatctgggctggttcgacacctacgaggtcgtcggcggcggcaccatcaagatcgccatgcagttcaccgacttcgcggacgacacctacatgtacatgctccattgccatctgctccagcacgaggacgagggcatgatggcctcgctcatggtgacggagagctagggcgctgaagccctgtccggtacggcggggcggcaggtacggcgggtacggcaggtgcggcggcgtcagctcaggcccgccgtccgtgcccgctccaccgcggggccgatcgccttcgccaccgcctccacatccgcctccgtggaggtgtggccgagggagaagcgcagggtgccgcgggccaggtccgggtcggtgccggtggccagcaggacgtggctgggctgggcgacgcctgcggtgcaggcggagcccgtggagcactcgatgccctgggcgtccagcagcaggagcagcgagtcgccctcgcagccggggaaggtgaagtgcgcgttggccgggaggcggcccgcaccggacgggtcaccgccgaggatcgcctcgggcacggccccccgcacggcgtcgaccagatcgtcgcgcagggcgccgatctcgcgggcgaaccactcgcgctgctcggcggcgagccgtcccgcgaccgcgaaggacgcgatcgcgggcacgtcgagggtgccggagcgcacatgccgctcctgaccaccgccgtgcagcacgggtacggggctgtactcgcggccgagcagcagcgcgccgatgccgtacgggccaccgaccttgtggccggagacggtcatcgccgccaggcccgaagcgccgaagtcgaccgggacctggccgaaggcctggacggcgtcggcgtgcagcgggaccccgaactccccggcaacatcggcgagttcccggaccggcatgaccgtgccgatctcgttgttggcccacatgaccgtggcgagggcgacatcgtcggggttgcgggcgatggcctcgcgcagcgcttcggggtggacgcggccgtaggtgtcgacggggaggtactcgaccgtggcgccctcgtgctcgccgagccagtggacggcgtccaggacggcgtggtgctcgacggggctggcgaggacgcgggtacggaccgggtcggcgtcgcggcgggaccagtacaggcccttgaccgcgaggttgtcggcctcggtaccgccggaggtgaagacgacctcgctggggcgggcggcgagggcctcggcgagggtttcgcgggcctcctcgaccgtgcgccgcgcgcggcggccggaggcgtgcagggaggaggcgttgcccgtgacgctcagctgggcggtcagtgcctcgaccgcttcggggagcatcggcgtggtcgcggcgtggtcgaggtaagccatgatgagcccgattctacgggccctgcgggtaccggcctcggccccccacggccggccgtcgccgtcgaccgcggcttcgaggagagccgcaagggaggcaaggcgggcaaggggcgagcaaggcggccggggattcggccgcggcccgtcgtccacgggcccccaacggccgatgacggcgtgggttccggctacacggctcgggccggcagccctagaagctccacgaaaccgtgtggtccagttgcatcgcgaccaccaggacggccaggtcggccacgcccaggccaaggcccaggagtgcgcggccccggcgctgcgtgccgcgccacagggcgacggccgccagggcgatggcggtcgggccgaggacgatgttgagggcgaggatgccgatcaggcccaggacgaaggacgccacggccatgccgtcggcgtcccgcgcgggagtgcggctggtcgatgtggcggtgagttccatgatgcggtcagctcccgggagcaggtgacggtcgatggatcagttggtcgaggtgcgtcgccggtgaccgtgccgctcgcggatcgcgaagaccacgagccacaggccgatgacggccgcggcgacaagggagacggagagcggggcgtgggccacggcgcccagcacgacgcccaggagcaggagtgcggcgacgaggaacagcatgggatgggatgcctctcgtgaggtgctcgcgtgacatttgagtgaacgcttgtagtaacacttgttcactgactcttgagtctagcgcgcttcccgacttttcaattacagagaacagttgttaactgcatggtatgagtcacaccctcggcatccggcaggcccagaagcagaagacccggcagtcgctcctggacgccgcgttggccctgctggaggagcagagcctgagcagcctgggtctgcgcgaggtcacccgcgccgtcggggtcgcaccgaccgccttctaccggcacttccgctcgacggcggacctcggcgtcgccctcgtggaggaggcgctgggcagcctgcacctgatgatcgggaacaccgtctccgacgccggcgacagcgaggaacgcatagcgcgcgccgtcgaactgatcgcccgccatgtcgccgcgcacccggcgcacgtccgtttcatcgcccgggagcggcacggcggcgtccagccggtgcgggaggcgatcgcggagcaactggcccggttcgccgaggaggtcaaggtcgagctggccaaacaccccgagtccgcggggtggagcgacgacgatctgctgatgctcgcgggcctgtacgtcgaccagatgctgatgacggcctcgctcttcctggaggcactggaggggccggaggaggaacgggagcgcgtcgccagggtggcgacccgccggatgcggctgatcagcatcgggcgccgccactggctgggctagggcctgtcgttttcggcccagcccggaagacccgccccagacccgccctcgcgggcccgcacgtacgggagcggcgcgcccgtgcaccgagcgcgccgcccccgcccgcaggggatcccccggcggagatcccgggtcagccctgggcctgctgcccctggccgccctgcccgccgccgccctgccccccgccggggccgccgcagcctccgcgccccccgccaccggggccgccgctcggcatgcccgacggggcgcccgacggggccttgccggtggccttccccgtcggcgcgccggagggagcgcccgagggcgcaccggacggcgcaccgctgggccgccccgaggcaccgccgctcggcatgccggacggcggctgacaagtgctctgccccgaggtgccgctgttggaggaggacgagtcgcccgagccgcaggccgccagcagcggtgcgacggccagcagggccacgacagggacaagacggacacgcttcatgaggccaactcccgagcgatgagcggatctgaggcgggaatgcaatcaacggcctctaagacttctgtgagtcagctctgtgcccagcctgtgcaaaaggcaaagccgacctcaacagatcccgctgaccagcgcatacgcacatccgctcgccgtactcactggtacagctccgtgacggaggccgccgcccgcgccagttcctcccgcacctcgggcggcgcgacgacctccaccaggtcggagaacatgagcagttgacgtgcctcgcggacgaagccgtacgacagccgtgccgtcacccactcgctctcgccgtcgtcctccggcagggcggcgagcgaggaggcgttcaggcgccggaacatgtcgagccggtcgcgccgcacccggaccgtgacctcgatcccgcccggccgctcctcgacctgccggcgcaacacctcccaggcgtcggcgagttcgacgcccggccgccgtcgtaccggatccgccagcagggtcgccgagcgcacccggtccgcgcggaacagctgcggcttcgcgcgccggtcggcgaccaggtaccagacgcccgccttggagacgagcccgtacgggtcgacggtgtacgtgtgcggctgtgcgtctccgccgtgccggtagcgcagccgcagcctgcggtcggcgaagaccgcgtcctggagcgtctccaggtcgacgacgggctgcgggccgcccttccagcgggtcgcgtcgacgaggacgcgccggctggtggcctcggcggccggccggtgcggcgcgggcagcgcggtcatcaccttgcgcagggccgaaccgagcgccgcgtccaggccgagcgcggcgtgtgcgccctgcgccgccaggatgaacagggcgcgggactcgtcggcggtcagtcccgtgacgtccgtacggaacccggcgaggagttcgatcccgccgtgccgcccgcgttcggcgtacaccgggaccccggaggccgacagtgcctcgatgtcgcggtagatggtgcgcaccgacacctccagccgggtggcgagttcgtgcgcggggacccggcctcgggtctgcagcaggagaaggatcgagagcaggcggtcggacttcaccgcaccagaatcccggtcgtcggccgggccacgcaaatgttgacgggaactgtcaggttatgcggcgaacctgggggcacagcaacagccggacccacggaagagacaccagtgatgaacaccgacccccgccccctgtacgcccgcgccgccgagcagatcgccgcgctgatcaggaccgtgcgcccggagcagctcgccggtcccacgccgtgcggcgagttcgacgtacggacgctgctgtcccacatggccggcggcacccgccggatcgccgtggtcggcgcgggcggcgacggtctcgccgtgcggccgttcgtggacggcgtgccggacgacggctgggtggcggcgtacgacgaggtcagggcggaggtcgagcagagctgggcggacgacgcccggctggacgcgctggtgcacgtgccctggggcgaggcgccgggccgtatcgccctgtcgggatatgtgatggaggccgtcacccacacctgggacctctccgaggccctcggccggccgctcggactcgacccggaactggccgagttcgcgctcgccatcgcccatcgggtactgcccgacgagcagcgcggggacgacgtgcccttcgactcggcggcgccggcccccgagggagccgacgcgtacgagcgactggcggcctggctgggccgccgttccctcagccgagcctgacccgcgccagctgccgggactgcgcgaccagccggtccgcgctgtcccatacctcggcgtcctcctccaggaagccgccggcgaggttacgtgtggtgatcgacacccggagcgggcccggcgcggggcgggaccgcacgtgcaccgtcagttcgacggtcggcacccagccggacaggcccagctcgaaggcggtcgggggcagcgcgtccaccgcgagcagcagggagagggggtccgggtcgcggccgtcggcgaggccgaaccaggaccgcatctcgcccttgccggacggcgcgccgagcgcccagcccagggtctccgggtccagcttgagcatcagccggtcggtgatggcggagctgccggggaccggggcggggccgtcttcgggcccgaagcactggtccatcggcgggagtgcgggcggccgcgcggtcgtacggacgtcgtcgggcagcgtgtcgaggtcgccgtacgaggcgaggacacggatccgctccacttcgcggccctcttcgtcgtactggaagagcgaggcctggccggtggagagggtgcgaccggtgcggacgatgtccgtgcggatcacggccgggcccggctgggaggccgtcaggtagtgcgcggagatcgtgaacgggtcggcgtgcggcagggcgtcggacagggcgcggcccaggacggccaggagatagccgccgttgacggcgctgatgatcgtccacccggcggagaggtcgatgtcgtagacgccgggttcgcgcagggtgaccgcggtgtcgcggtcgaactcactgtcaccgatcgaggcccgtacggcctgcaggggagatgcttcaggcatacctgaacggtacaacaggaaattactaagcagtagctttttatgttgcggccagatgacatccctgggaccccaggggtcccagggccctggggggctactcctccgtcacggtcgagcgccggtgccaggcgcgcggcgcccgccagtggaagcgcatcgcgagcagccgcaggacgaaggcggtgatcaccgcgaacccgctggtgaacgcgttcagcgcgtcgtagtggatacacaggacgatcatcgtggcgccgacgatcgcgggcaccgcgtacagatcccggtcccagcgcagcagggaggggacctcgttggcgaggacgtcgcgcagcacaccgccgccgaccgcggtggcgagaccgagggccgccgaggcggtgaggttgagcccgtagtcgtacgccttcaccgtgccggcgacgcagaacaggccgagcccggccgcgtcgaagacgttcacgccgagctggatgcgctccacctgcgggtggaggaagaagacgagcagggcggcgagcagcggggtgaggaagtaccccaggtccgtgaaggccgccgggggcaccgccccgatgatcaggtcgcgcagcagccctccgcccagcgcggtgacctcggcgagtacggcgatgccgaagacgtcgaagttcttgcggacggccagcagggcgccggagatcgcgaagacgaagatgccgatcaggtcgagcgtgtgctggacggaggggctgaacagttgttggagcacccggacattctcacctgtcagcgggtgtgaaccttacaaagcaaggcttacagggtgggcttgcccgtggtgaacagccaggtctggaagaggtcgtccagctgtcggccggagatcctctcggcgaggcggatgaagtcgccggtgttcgcgttgccgtgtttgtgcagcttggtccaggcgggcagcagcttgaagaaggcggtgtcgccgatgcgctcgcgcagcatctggagcgtcatcgcgccgcgctggtagacggcggaggcgaacatggtgtcgcgctgcggatcggcgaccttgatctgccagaaggccgcgtcggcgggccgggcgtcgtatccggcccggaacgagtcgtgcgccgagcggatgcccttgtgctcggaccacagccactgggcgtaggtcgcgaagccctcgttgagccagatgtccttccagcgctccaccgacacggagtcgccgaaccactggtgggccagctcgtgcacgatggtcgactcggagcgcacggccgagtacgcgggcttcgactggacctccagcgagaagccggcctgcggcatgtcgtcgacgatcgcgccggtctcctcgaaggggtacggcccgaagatctgcgaccagtagtcggtggcctcggcggtcacggcgtagacgtcgacggtgttgctgttcgcgagcaccgggtcgatggcgacgtagacgggcgtacccgcgggggtccgccccgtcttcacgtcgaacttgccgatggtcgcggtcgcgagatacgtcgccatgggcttgctctcacgccagtgcgtgacggtggtgtcgcccttgtcgcgcgtcgatatgaggcgcccgttggagatgcccgtcaggcccttgggggccttgatgcggatgtcgtacgtggccttgtcggcggggtggtcgctggacgggaaccaggtggaggcggcgttgggctcgcaggcgacgaagacgccgtccgcggtcttcatccacccgtagtcggagccgaagacgatggggccgccgaggggttgggggacaccgccgtaggtgacggtcaccgtgaaggttctgcccttcggcagcgcgccacgcggggtgacgcggatctcgtcgccctcgcgcgtgaactcggcgcgtctgccgttcacttcgaccttcgtgacgtcgagcttctggaggtccaggtcgaaggaggacaggcgctgggtggcgcgggccgtgagggtcgtacggccgtcgagacggtcggtgtccgggttgtacgccacgtcgaggtcgtagtggcgtgcgtcgtaaccgccgttgccgagctgggggaagtaggagtcgccgatgccgtcggcgcccggggtcggggcggaggaggcggcgatgacaagaaaggaggccgccgcggtcgcgagggcccccagtcgtgccgaacgggagagtgccatgagtcgtcccttcgagcgtgttccgatcagacggacacgccagactctgcactctcccgtttagacatgtgcatgactttaccaagtcgtcatggcctacttgtcggttgactcctgacggcccgactccgcttccgccgactcggcggcggggtcttcgtcgacggggtctgcgacagcggggtctgcgacagcggcgggctcgtcggcggtgtcggcgtcggcgggctcggcggactccgcgaccgtctccgcgacggctgccttctcgaccgtctccgcagcgaccgccttctcggcgacagccttctcgaccgtcttctcggcgacagccttctcgacagccttctcagccgccttctcggcgaccgtctcctcgacagccttctcagccgccttctcggcgaccgtctcctcgacagccttctcagccgtcttctcagccgtcttctcggcgaccgcaacgtcggccgtcttcgccggcgtctgcggagtctcccccaccgacaccacctcgatcgcctccctcgccgccgagagcagcaccgtgtcctgcggcgcctggtcctccgcgttctccgggtggtggcaggcgacctgctgaccgggcttcagctccagcagcggcggctcggtcgtccggcagatctccgtcgccttccagcaccgcgtgtggaagcggcagccgctcggcggcgagatcggcgagggcacgtcacccttgagcaggatgcgctcgctcttggcaccccggcgcttggggtccgggaccggcaccgccgacatcagggccttggtgtacgggtgcatcggcgcctcgtacagcgaggtccggtcggcgagctcgacgatcttgccgaggtacatcacggcgatacggtccgagacatggcggacgacggagaggtcgtgcgcgatgatcacgtacgtcaggcccagctcggactggaggtcgtccatcaggttcacgacctgcgcctggatcgacacgtccagcgccgagaccggctcgtccgccacgaccagcttcggcttcagcgcgagcgcgcgggcgatgcctatgcgctggcgctggccgccggagaactcgtgcgggtagcggttgaagtgctcggggctcagacccaccagctccaggagccgctggacctccttcttcacgccgccctcgggctccacgccctggagccggaacggcgccgagacgatcgagccgatggtgtgccgcgggttcagcgaaccgtacgggtcctggaagatcatctggatgtcccgccgcagcggacgcatcccggccgtgctcagccgcgtgatgtccttgccctcgaactcgatggtgccgccggtcgggtcctggagccgggtgatgacccgtcccatggtcgacttgccgcagcccgactcgccgaccacgcccagggtctcgcccctgcgcacctcgaagtcgatgccgtcgacggccttcaccgcggccacctgacgctgcaggatccccttcttgatggggaagtgcttggtcagcccctggaccttgagcaggacgtcgcgctcctcgggagccgacccctggtgcgggaccttcgcggcgggctcggtcgcgtccgctttcttcgtctcactcacagcttcggcgcaatctcttcggtccagatccgcgtacggtcctcctgcgagaggtggcaggcggaccagtgtccgccgccgacctgctgcagttcggggcgcacggtgcgggtgacgtcgcccttgggcacgtccgcgtacgggcagcgggggtggaaggcgcaacccgaggggacgttgatgaggctcggcggctgacccttgaccgggatgagccggtcggacgtgtcgcggtcgatgcggggcatcgagccgagcagaccccaggtgtacgggtgctgcggctgctcgaagatctcgtcgaccgggccgcgctccacgcaccggccgccgtacatcaccaggacgtcgtcggcgatctcggcgaccacgccgaggtcgtgggtgatcaggacgaccgcggagccgaactccttctgcagatcccggatgaggtccaggatctgcgcctggacggtcacgtcgagcgcggtcgtcggctcgtcggcgatcagcagttcggggttgttcaccagcgccatcgcgatcatcgcgcgctggcgcataccgccggagaactcgtgcggatagctgtcgacacgcttggccggctcggggatgccgacccggtcgagcatctcgaccgcacgcttgcgcgcgaccttcttgctgacgtcgtggtggacccggtacgcctccacgatctggttgccgatcgtgtagtacgggtgcatcgcggacagcgggtcctggaagatcatcgccatctcgcggccgcggagcttgcgcacctcgtccggggcggcggacaccagttcctggccgtcgagccagatctcaccggacatctgcacgttcttgccgcgcgcgccgagccggtgcagacccatgatcgccagcgaggtgacggacttacccgagcccgactcgcccacgatgctgagggtcttgcccttctccacctggaagctgagcccgtcgacggacttgaccagaccgtcgtcggtggggaagtgcaccttgaggtcgcggacctcgaggaaggcacggggcgcgtccgagggcgagcgggtgggctcccccacggcggcgccggtcttggacagttcggtcacgagagcctcacccgcgggtcggcggctgcgtacagcaggtccaccaggagatttgcgatcactacgaagaaggcggcgagcagggtgacgccaaggatcgggggcaggtcgttgtcctggatcgccttcacggcgtactcaccgacaccgtgcagcgagaacaccgactcggtgatcagcgcaccgccgagcagcagccccaggtccatgccgaagaccgtgatgatcggggtcagcgcggccctgagaccgtgccggaccacgacgttgcgctcgcgcagacccttggcgcgagccgtgcggatgaagtcctcgttcatcgtctccatcatgcccgagcgggtcagccgcgcgtagatggcggagtacagcagagcgagggaacaccacgccgggaagagcgtgttggcccactgcgcgggattctcggtgaacgggacgtacgtacgcccgaagatcggccactggtaggtgaagagcagcagcgcgaggttgcccgtgaagaacatgggcagcgagacaccggcgagcgcgacccccatgaaggtgcggtcgaagaacgagcgcggcttgagcgcggagatcacgccgaccgccacaccggacagcagccacagcacggccgcgccggcggccagtgagatcgtcaccggaaggcgcgaggtgagctgcggccagaccgcgacatgggtcttgaaggagtaaccgaagcacggcgcgtcacagtgcgccgtggtgggccccaggtcataggtggcgccggacacgatccccttgatgaagtgccagtactggacgtacaggggctggtccagaccgaggttgtgcttgacggtcgcgatgtccgcggcggtggggctcttcccgatgtactgctgagccagttggtcggcggtctggccggccatcctcggcagcaggaagaagatcgcaaaggtgaccgcggtgacgaccagcagcaggatcactgccgcgaacgtccgacggaggatgtacgagatcacggggatcggcgctggtgcccgcgggccgcgaagcccgcgggcaccaatgccttcacctgccttccggggctacttcttggtcgagccgatgttgaggtagtcgtactgaccgctgaaggccgccgtcgacaccaggttggtgtacgtcgtcgggcggtacagcaggaccttgaagtaggtcagcggaacgaggaccgcctcgtccatggtcttcttgtcgatctcggtgtagagggcgtcgcgcgcggtcttgtcctcggtaccgatcgccttgcccagcagcgagttgacgtccttgttgtcgaactgggagaggttcacgttgcccgaggaaccgatggcgctgccgttcaggacctgctgcaggaagccgtagccggacggccagtcggcgccccactgcatcatgatcagaccgaggttctgcttctcggtgaacttcgggacacccgcgtagtcggtgaagtacttgcccgacgggtactgcttcaggctggcgtcgatgccgaccttcttcagcgagttgatgatcgcggtcgccgcgtcgatctcctgcggacggtcgctgcgcgccgagatgttggtcttgatcgacgacttgccgcaggccttcagctgctccttggccttggccgcgtcacccttgttgccggaggtggcgtagacgtccgacttctcgtagcccgggatgtccggcgggaggacggtggaggcgatgtcaccgcggatcgggccgccctcggcggtctgcaccgagaccttgtcgatcgcgtactgcacggccttgcggcactcgagcttgtcgaacggcttcaccttggtgttgatcgccatgtagacgagacggccaccgtaggtgttgtcggtgttggccttcttctccgcggagttgacgacctgcgcctgcgtcgcggcctggacacccgtaccacccaggtcgatcgcgtcgccggcctggacgtccttgtcgatggtctcggcgttgaccttcaggttgaccacgatcttttccgggtactgcttgcgcagcgggtccgtcttcgggtcccagttctcgttgcggacgaggacggcctgcttgccgtcgtcgtagctctggaacttgtacgagcccgaggacacgatgctcttgacgtagtcgatgcccttgtccttggactggggcaccggagccgtctgcggcgccgcgaccaggtagtcgaactcctggaaggcgcggttgagcttgaagacgatcgtggtgtcgtccggcgtctcgatcgacttcaggcccttggcgctcttgtccttgtagggacccttgtacttgtcgccgcccacgaggaactgctggaagtagttcgggccgagggagagcacgtcacgcgcgaagttggagcgctcgacggcgtacttgacgtccttcgaggtgatcgcggtgccgtcctggtacttcagccccgaacggagcttgtacgtccaggtcttaccgccgtcgctcggcacacccgcgctcgcggcgaggtccgggaccagctcgttgcccttctcgcccggggcgggcttgaaggtcatcagcggacgggcgtacagccggctgaggttgtacatgtacgcgtagtacgtgttgccggggtcgaaggagtccgggacatcggagtactcgtaggtgaccgtgccccccttcttggtggaggcgttgacgacgtccttggtcgctgcgttggccccagccgacttcgagttgttgtcatccttgttgtcatcggccttgctgcagcctgcaaccagcagactcgcactgccgatggccgcaatcgcggccagcgctgaccttcgcatgatggtcgggttcccctccattgtcggaaacttgatatgccctcggagcggccggtctcagcggctgcgcgggtcgagagcgtcgcggagaccgtcgcccagcaagttgaacgccagcacggtcacaaagatggcgaggccaggcacgatcatgtactgcgggtccacctggtagtaggtgaccgcttccctgagcatcccgccccaggacgcctgcgggggctggataccgaccccgaggaagctcagggacgcctcgaagagaatgttggtcgggatgagcagcgtcgagtagacgatgatcgggccgaccaggttcggcagcagctcccggaagaggatgtacggacccttcgcgcccatgccgcgggaggcgtcgacgaactcccgctcgcgcagggccagcgtctgcccccggacgatacgtcccaggtagggccagttgaagaagccgatgacgaagatcaggacgctgaggtggagcggcagcccttccataccgaaggcgccgccctggagcgttgcggagatggcgatggcgaacagcaggagggggaaggcgaggaaggtgtccatcagccggctgatgatcgtgtcgacccgtccgccgtagtagccggccaccacgccgaggatcgcgccgatcacgttggacaggatcgtggcaccgaacgcgacgaccagcgagacccaggagccctccaggacgcgggtggcgatgtcgcgtccgaacttcggctccacacccagcgggtggtctccgctcatgccgccgaagcttcccttgggaagggaggtgttcgggtcgatcaggtcctggttgaaggcgttcgggtcaagacccagcagggcctggatggggcgggagagcaccgcgaccaggatcagcaggatgacgatgacgccgccgacgacggccaccttgtccctcttgaagcgggaccaggcgatctgccccagggaacggccctcgatctgccccttctcggcgccgacgagcacagcctccggctgtgcctcggctgccgccccggtggtctcgatcggtgcggtcacagtgacccgacccctctcgccggtggtgaccggcctacgcccgccgctgtctgcggcttggttcacttgcgcgccgagcggcgaccgcagatgatgcggcccgatcgcccggctgattcgtcgactttcaccagctcacagaattgaagaatctgtgtctgcctggggagtcttcagcgagtcgtcgatcacgtgccagacctgacgacgaaagtatgcgcaaccgtgatgatgtcagagggattccgttatccgaacgcggggtaatagccttcggacacagggcagttgggacacaccggcaatatggtgacgaacaggatcatccgccgtcatctacgcgcgaagaaggccgtgacccactgtgaccgccgccaggggcgcggcagccggtcagtacccgccgcgggccggcgggtatccgtacccgcccgccgccggggccggtgccggtgccggggccgcgtgggcctcacggtcgtagaagggacgggcgttggcgcgcagccacatcgcgaccgggtcgtacgcgtcggacatcgcgacggtcgagacgggcagtccgtccgggaccgcgccgatggactgctgcatcatcccgcgcacggagtcgacggccggcggcgacgtgtcgtacacatcgaggccgatggccagatagggcgcgccgagggcgggctgcacccaggcgcggcgcagtgagcgcacggcgggcgtgcggtgcgcgttctgcgtgagcagggcgtagaactgggggacctcgatgcccggttcggagagccggagcgggccggccggctggcgctccaggcccgtggcgatccggcgcaggtccagccaggggatgccgacgccgccgccgggggcgtgcgggttcagccagaggccgaagtggtcggggtagagggtgcgggccacgtcgaggccgtcgaccacctcgtacgatctgttccagccgctggccgagagctcctgggcggaggtgacgcagggcgcgtagccgtagccgtcgacctccatgttcccgtactgggcgtcgggcgaaccggcctgaccgtgccacagcagcatccagatctggccggccgacggggtcgcgagcgcacgaaggagcgcctcgtaggcgtcgtaacgcccgggcgtcacctggcgcagcatgtgctcgacctgcccggccgcggccgtgcccgacgcgctcaccttctaccgccccttcgcgacaaactcacgacaacgtcatccccgctcaacacctcgaccgagccatgaaaccagcttaagcggcgatcctgacagcgacttggccccacgtcgcccgaggtgtcgccgccggcggccggccggtcagtacccgtgctggtagaacggccgcacctgggcccgcatccactcgcccaccggatcctgggccacgtccaggaagaccatgttcaccgggcggtccaccggcacccggcccagcgcgcggccgagggcgtccagcgggagcgtacgggcgtcggcctcccacgaggacagttcgacgccgatgaacatcaccgggtcggaggtctcgatggcggccatgcagcggcgggcgctcaccacgatgccggtctcggcgaactcggctgaggccgccgcgaggaagtccaccgggtcgtcctgccagtccggctcgaacagccgcacccggccgccgctcgcgggcccgtcgagaggggtccggccgacccggcacagttcggcgaccgcgtccggcggcagcggcacgcccaccacgccgtccgggttgaccgcgatgccgacctgcggcggcagcccgcgcgcgaactccacggcgggcgcgatcgtgtacgacatgtggttgccgacgacctggcggaactgctcctcggagctgaagaccgggacgaacgcctggccgtcgagctccagcgtgggcaggtcgagcgggccgctgtgcggtccgcccccgccgggcagcggcacccagacgaaactgtggccgaggacctccacgatccgggcgcccgtcgacggcgacgcgggtacgccgagggacgcggagagcacctcctccagttcgttgccgggccatccgccgtgcgaatgggagtgcgggtgcgcctgtgccgggatgtccatctgtctaccgcctgctgtgaaccgccgttgaaccgctgtttcggctggaaacagtagtgggtgagcggggcgccgggagaggccggacggtcggaccgctcccggggctcgtgctgttgctgccgctcgggccggtgcgcgcggctgtgcgctcaggccgccgtcgccactccggccgcgaagtcgatgcggttcagtacgtccgccgccgtgcggtccatcaggatcgccgaaccacagccctcgggcagattccccttctccaccgagcgcagcaggtgacccgccgccttgcggtgcctgaggaacgcgtagcgcgagacgccccggccgcgctcgcgctgcccgtccagcgcggtgcccaccgtgacgtcgaggagcagcaggtgcagcgtgccgccgcggcggcgggcctcgcgggcgagccagcggcgcacccaggcctgcgtaccgcagtcgtgcacgacgacgcccgcgccggagcgcagcgcgcggcgcagtcccgcgtagtgggccagccggaccagcggccggtagaccgcgtacggcaggaagccggccagccgggtgtcccagcggtcgcgggtgtcctgggagtcgacacgggcgccccgcaccgcccggcgcatcagcgtcgacttgccgctgccgggcaggccggtgaccacgacgagatcggccgcgccgaaggtgagtccgtgcgggctgcggcccgcgcggtcacgcaggtcgcggacgacggccgccggctgcgggccgcacgcgtcccgggccggtactccgggctgctcgggcagcgcgatgcccgaggtcgtcgcgtacgccgtaatcctcttcaccgtgatcgtcctccccagtgggtctggagtcccatccccgtcgagtgtaaagagaaggtaatgcgcgatgcctctcgtttccgtactcggagtgccacaggccggttacagatgcggccctgccgcgcgcggacgatgcgtgcaatgatgtgcccgccaactgcataccggccgcttgaatccgcgcgggagagttccgggtacgtgtgcccggacgccgaaggagcaagtccctcccttgaatctctcaggccccgttaccgcgcgggcgaggcacatctgaaaagcgggccgctgtccagtggctccacccaaggtgcaagccagtgacccgtgacggtcatggcgaacctctcaggttccgatgacagatggggaggaacgacctcgccgtcatgccttgggagcaccaccgatgagcagcaacgcaccccgtcacaccgcgctcgatgccctgcatcgctcgctgggcgcgacgatgaccgacttcgcagggtgggacatgcccctgcgctacggctccgagcgcgacgagcacctcgccgtccgcagcaaggccggtctcttcgacctctcccacatgggcgagatcaccgtcaccggccccggggccgccgcgctcctgaactacgcgctggtcggcaacatcgcctccgtcggcgtcggccgcgcccgctacaccatgatctgccgggccgacggcggcatcctcgacgacctgatcgtgtaccggctccaggagcagacgtacctggtcgtggccaacgcctccaacgcccaggtcgtcctggacgcgctcaccgagcgggccggcggcttcgacgcggtcgtgcgcgacgaccgtgacgcgtacgcgctgatcgccgtgcagggcccggagtcccccggcatcctcaagtcgctgaccgacgcggacctggacggcctcaagtactacgcgggtctgccgggcacggtcgcgggcgtcccggcgctcatcgcccgcaccggctacacgggtgaggacggcttcgagctgttcgtcgaccccgcggacgccgagaagctgtggcaggcgctgaccgaggcgggcgccccggccgggctcgtcccctgcggtctgtcctgccgggacacgctgcgcctggaggcgggcatgccgctgtacgggcatgagctgagcacctcgctcacccccttcgacgcggggctcgggcgggtcgtgaagttcgagaaggagggtgacttcgtggggcgcgaggcgctcaccgaggccgccgccctggccgagaagaacccgccgcgcgtcctcgtcggactgatcgccgagggccgccgggtgccgcgtgccgggtaccccgtcgtcgtcggcggcgaggtgatcggcgaggtcacctccggcgccccctcccccacgctgggcaggccgatcgcgatggcgtacgtcgacgccgcgcacgcggcgccgggcacggccggggtcggcgtggacatccggggcagccacgagccgtacgaggtcgtggcgctgccgttctaccggcgccagaagtgacactgggcacgtcttccccgcctcaccgggcacgtcttctctgatcaccgagcgcgttctccctgatcaacgacagtcccccgggcatgcccaccagcagtcccccgttcaccaccactcccccgcgtacaggagaattcacgccatgagcaacccccagcagctgcgctacagcaaggagcacgagtggctgtcgggcgccgaggacggcgtctcgacggtcggcatcacggagcacgcggccaacgcgctcggcgatgtcgtgtacgtccagctcccggaggtcggtgacacggtgaccgcgggcgagacctgcggcgagctggagtcgaccaagtcggtcagcgacctgtactcccccgtgacgggcgaggtcgtcgaggccaaccaggacgtggtggacgacccgtcgctggtgaactccgctccgttcgagggtggctggctgttcaaggtacgcgtcgcggaggagccgaaggacctgctctccgcggacgagtacaccgagttctccggctcttaaggatccgtatctgatgtcgcttctgaacacgcctctgcacgagctcgacccggacgtcgccgccgccgtcgacgccgagctgaaccgtcagcagtccaccctcgagatgatcgcctcggagaacttcgctccggtcgcggtcatggaggcccagggctcggtcctcaccaacaagtacgccgagggctacccgggccgccgctactacggcggctgcgagcacgtcgatgtggtcgagcagatcgccatcgaccgggtcaaggagctgttcggcgccgagcacgccaacgtccagccgcactcgggcgcccaggccaacgcggccgccatgttcgcgctgctcaagcccggcgacacgatcatgggtctgaacctcgcgcacggcgggcacctgacccacggcatgaagatcaacttctccggcaagctgtacaacgtggtcgcgtaccacgtggacgagaccaccggccaggtggacatggccgaggtcgagaagctggccaaggagtccaggccgaagctgatcgtggccggctggtcggcgtacccgcgccagttggacttcgccgcgttccgccggatcgcggacgaggtcggcgcgtacctgatggtcgacatggcgcacttcgccggcctggtggcggcgggtctgcacccgaaccccgtgccgcacgcccatgtcgtgaccacgaccacgcacaagacgctgggcggcccgcgcggtggcgtgatcctgtcgacggccgaactggccaagaagatcaactccgcggtcttcccgggtcagcagggtggtccgctggagcacgtgatcgccgccaaggccgtctccttcaaggtcgccgcctccgacgacttcaaggagcgccagcagcgcacgctggacggcgcccgcatcctggccgagcgtctggtccgggacgacgtcaaggccgtgggcgtggacgtcctctcgggcggcacggacgtgcacctggtcctcgtcgacctgcgcgactccgagctggacggccagcaggccgaggaccgcctccacgaggtcggcatcacggtcaaccgcaacgccatcccgaacgacccgcgcccgccgatggtgacgtccggcctgcgcatcggtacgccggccctcgccacccgcggcttccaggccgcggacttcaccgaggtcgcggacatcatcgccgaggcgctgaagccgtcctacgacgcggacgccctcaaggcccgggtgacggcactggcggacaagcacccgctgtatcccggtctgaagtagttcatccctcggggcaccgtgcacactgggacgtgagcgcggtgccccgccccttgggccggtccggtcgggccccccttgttccacccccgttttgaggagtcaccgtggccatctccgtcttcgacctgttctcgataggcatcggcccgtccagctcccacacggtgggcccgatgcgggcggcgcgcatgttcgcccgccggctgcgcaacgaggagctgctggacccggtggcctcggtccgcgccgagctgtacggctcgctgggcgcgaccgggcacggtcacggcacgcccaaggcggtgctgctcggcctcgagggcgcgtccccgcggacggtcgacgtggagggcgcggacgaccgggtggcgacgatcaaggagtcggggcggatcaggctcctcggcgagcacgagatcgcgttcgacttctccgaggacctggtcctgcaccgccgcaagacgctcccgtaccacgcgaacggcatgaccctgtgggcgtacgacgcctcgggcgccgaactgctgtcgaagacgtactactcggtgggcggcggcttcgtcgtcgacgaggacgcggtgggcgaggaccgcatcaagctggacgacacggtcctcaagtaccccttccggaccggtgacgagctgctgcggctcacccgggagacgggtctgtcgatctccgcgctgatgctggagaacgagcgggcgtggcgcaccgaggaggagatccgcgaggggctcctcggcatctggcgggtcatgcaggcgtgtgtgtcgcgcggcatgtcgcgcgagggcatcctgccgggcggtctgaaggtgcgccgccgggcggcggtctcggcccgccagctgcgcgccgagggtgacccgctggcccgtgccatggagtggatcacgctctacgcgatggcggtgaacgaggagaacgcggccggcggccgggtcgtgacggccccgacgaacggcgccgcgggcatcatcccggccgtgctgcactactacatcaacttcgtgccgggcgcggacgaggacggggtcgtacgcttcctgctcgcggccggcgccatcgggatgctcttcaaggagaacgcgtccatctccggcgcggaggtcggctgccagggggaggtcggctcggcctgctcgatggcggccggcgcactggccgaggtcctcggcggcactcccgaacaggtcgagaacgcggccgagatcggcatggagcacaacctcggcctcacctgcgaccccgtcggcggcctggtccagatcccgtgcatcgagcgcaacggcatggccgcggcgaaggcggtcaccgccgcccgcatggccatgcgcggcgacggctcccacaaggtgtccctcgacaaggtcatcaagacgatgaaggagaccggcgcggacatgtcggtcaagtacaaggagacggcgcggggcggcctcgcggtgaacatcatcgagtgctgaacccgcctgcgcgccgccgttcacagggtcatggtttccgttcccgggcgggatcactcgtgcaaaggtgggtacaggcatcaactcctgtacccccacccgcacttcagggagcccccatgctgcgaggcatcgacgtgagcgcgtaccagtcgtccgcgtacgacaccgacggcctctccttcgtcttcatcaaggcgacggagggccgttcgtacgtcaacccgaagctgacggctcaggtgaagacggctcgcgacgccgactgcgtggtcggtttctaccacttcctgtggcccggcaacatcacggcccaggccgagtacttcgtgagcaaggctccggagaaggcgggcgacctgctcgccgtcgactgggagacgacgggcgacggcacccacgcgacgaacgccgagaaggaccggttcatccgcgagctcaaggaactgcggccgaatcaccgtgtggtcctgtacacgaaccggaatttctggctgaacatcgacaccacctcgtacgcgggtgacgggctctggatcgccgactacgtcaccgcgggcaagccgcgcatcaaggcgaagtggcgtttccaccagtacaccgatcaccccgtggacaaggacgtcgcggacttcgacaccctcgccgacctgcgggactgggccaccccataggctgcccggtatgggtgggacagtggctgcggtgagcagcaacgggacgtacacgttcaccaagccgaaccgggaaagcatcacgctgctcgccgggctgggggtcgagggcgatgtgcacgccggtgtgaccgtcaagcaccggttccggatgcgaaaggatccttcgcagccgaatctgcgccaggtgcacctgatgcacgaggaactcttcgaggagctgcgcggcgccggattcaccgtcgcggccggggaactcggcgagaacgtcaccacccggggcatcgatctgctggggctgccgaccggtgccctgctgcacatcggggacgaggccgtcgtcgaggtcacggggctgcggaatccctgcgcccagatcgacacctttcagaaaggcctgctcaagcaggtggtgggcagcgacgacggtgccgtcgccttcaagtccgggatcatgagcgtcgtgcgggcgggcggggtggtgcggcccggggactcgatcgaggtcgagttgccggacgggccgcacctgccgctccggaccgtctgacgtcaggcaggccgcggcggccggcgccggacggtccgcgcgtcccgcggcgtcacgcgcggaagtccgccggacgctccggggacgcctccgccagtgccttcgtcaccgcgtcgcggccctcctggaggccgtagaccggggttcccggctgctggcgccaggactcgtccagggtgcccgcgtcgaccgtgtcgaagccgagttcgtcgatcaggtcccgtacgacctgcttcgcggccgcgtcgtcgcccgcgaccgggagggccaggcggtccggggcgcccgcaggccgcgcgcggtcgaggatgtcctgggcgtaggtgccgttgaacgccttgacgacggtgtgaccgagctgccgggcggtccagcggctctccgtcaggccctcgtcctcgatcgcgtcgatcttcccgtcccgctgccgcgggtagtagttgccggtgtcgatcacggccacgtcgtccgcggcgccgtcgaggatcccggagggcaggtccggtaccgccttcagggggatcgtgaccacgacgaccgccgcgccgcgcgccgcctcctcgaccggcacgggcgtcgccccggtctcctcggccagtgcggtgagggtccccggtccgcgcgaattggccacggagacgtcgtggccgagggcggtgagccgccgggtgaggttgccgccgatgttgcccgcgccgatgatgccgatcttcatgacaggcccttccggagttgacgctcctgatgagaggcgtcaactcccgggacgtacgggctattccacggcgtacggcatccgggtgacgggtgccgggcgacgggtgccgggcgacgggcgacgggcgacgggcgacgggcgacgggcgacgccatcctgcctcttcgccggcaggcatgccgaaggggcgcccgccgaacccggtgggcgcccctttccgtgcgactcacttgttcaggtgggtccagaactcgtcgaacgagaggaccttgtccccgttgaggtcgcggctggcgatgatggccgatgccaccgactccgtgacgttccagtcgccaccctgggccagggcggtcttgaactcggcggccgtgataaagccgtcaccatccgtatcgatccgctcgaactgcttgcgtgcttcctcgacgtccgccaccggatccgccccttttctcgtaccttgctgtcctactgacgcaggtcagattaacggcccggccgagccctcagtgcggcgaccacccagccgaactcctcccggtgcgcgggcaggggtccgccgcccttcaccacggcgagcaactcgcggtatcgggccacccggtcgttggacgtggcctccagccgttccagcacggcggcccggtcggcggccccgtcggcctcgccgagcagctcccgcagcacctcctccgcctccggcgcctcgggggcgatcccccgctgccgcgcgtcggccgccaactggacgaggcgcctgacgaaccacagggaagcgccggccgggctgtcgtgaccgcggtcggccgcgttgaactcggccgccgcccgcatctgcgcccggaactccgggtcctgcaacagttcgaccagctccacccaggcgtccacctgctcgggcgtgggctcgtccggcaggtccacggcggtgttccgcatccgctcgcggatcaccggatccgccgtgtcgagcccgcggaacatctcgtccgcgaactcctccagaatccgcctccgctcggcggccgacagtcgcgccagcttgttcatcagtgtcatctcctctgcggtcgaaccgcgtcgcgccacggtcgacagcaccgcccgggtcaccttcagcgcacggatctgcgcgtccagcgccgtcacatgcgtggccgccacctccgcgaccgtcgtctcgccggccagcacctcgcgcacgtcgtcgaggccgaggcccaactcccgcagggtgcggatgagttcgagccgggccacggacccggcgtcgtacagccggtagccgcccgaggagcgcgtgaccggtggcagggcgccctcgtccgaccagtagcggatggtgcgcaccgacaggccggtgcgccgcgcgagctgtccgatggtgaacagtccggtgccgtcatcgatcatgtctgcgagtctgggccttccagcgggtggagactcaagcggggagaaggggcggaatgacggacgctctgcgggacattctggacgcggcggcccgaggggtcttcccgcccgccgacggcggcatcaccgtcgtaccccagcactcccaccgtgacgccggtgtcctcgccttcaccgcgcactccgtcgtcttcaccgacgaggaccccgcctgggtgtacgacaccctgcgcgcactcgactgcgacgcgctcgcggcgacgatgaacccgcggttcctggccgcgttcatggagcgcacgggccgtacgaccgacaccatcgacctgatgacggttgccccgccgctgccggacggccctccgctcgcgctgagggagatcgacgatcccggccatccccgggccgtccgggcgcgcacgcggcgggacggcatacgggtgtgggccgccgacgggggcgtgctcgtcctggggcgtgggatcggggggcggttggaggccgcggtcgaggtggacgaggacgtacggcatcgggggctggggcggacgctcgccacggcggcgcggcacctgggcggcggcgaaccggtgtgggcgcaggtggccgcggggaacgcccgcagtgcgcgggcgttccaggcggcgggctatcgaccggtgggcgcggaggccctgctcagcgcgtcgccccagtcgccccagtcgcctcagtcgccccagtcgcctcggtcgcctcagcggaagatgcccgtgtggcccagtgagtagcggccgggctgtgggtagaccgcgagcccgtgcgggccgctgccgaccttgatgcgggcgagctggacaccggtgcgggtgtcgatggcgtacacctcggagttgtagcggccggacagccacagcaccttgccgtccgccgagacgccgcccatgtcggggctgccgccgcccggcaggttccacttcttggtcagcctgtcctcggcgaagtcgaagacggagatggtgccctcgccgcggttggagatgtacatctcgcgcgagtcgcggctgacgtacaggccgtggcagcccttgccggtgtgcaggaacctcggctcgccgaacgtgtcgccgtccaggacccacacgccgtcggccatcatgtcggcgacatagaacttcttgccgtcgggcgagatcttgacgtcctgcggcatggcgccgtcgaacgggagcttctgctgcccgatcaccttcatccgctccgtgtcgaccttcagcagctcgccgctgaactcgcacgacacgatgaagtagcggccgtcgagcgagaagtcggcgtggttgacgccgtagcagctgaccggcacggtcttcatccgcttcatggtgtgcgcgtcccggaagaccagctcacggtcgagggaggccatcacgatcgcgtacgtgccgttgggcgtgaagtacaggttgtacgggtcgtgcacgtcgacggccttgcccacctcgccggtcttcgggtcgatgggggtgagggagttgcccctgtcgttgttgacccacagcgtcttcatgtcccaggacgggacgacgtgctggggctgggcgccgaccgggatcgtctcgatgacctcgtaggtgctcgggtcgatgacggtgacggtgttggagttggtgttggggacgtagacccgcgacgggaagtccttgaccacgggggagagcctgccggggcggtcggcggcgtagacgtccttcgggtcgagtacgggcggcatgccgggcaggccgtcgaccaccggcttcttctcggcggggggtacggcggccttggtggcgagggcctcgtccgcccggtccctggagtcgccgtcgcagcccgccagcagggcgagggacacgagggcggcgccggcggccagggtgcgcctgaggtgcttctcgatggggtggtgcatcagctcagcagctccgtggtggtcaccgcgcgcagtccgcggcggtcgagttcgtgcaggagggcggggagcgcggcgaccgtgtcggcgtacccgaagtgcaggctcaccacggatccgggccggaccccgccgaggacctggcgggtgacggcgggggcgcccggcgaggtgaagtcgagggagtcgacgtcgtacgacaggacgtgcgggtagccgacgcggcgggccacccgttcgacgagcggcgaggcacgggaggtgcgggaggggcggaaccaggtgccgatggagccggtcagccgccgcagccggtccgcgcagccgaggatctccgcgtacgcgtccggctcggacatcgcgttgatgtcgatgtggcgcagggtgtggttgccgaggtcgtggccgccgtcgaggatgcggcgggccatgcccgggtgctcgtcgagccaggtgccgacggcgagcacggtgacccgggcgcccgcgctctccgcctcgccgaggagcttctcggcgacggcggggtcgccctggccgtggaagctgagcgcgacccgggggcgggtgcgcgggccgtgggtgatctgggcgggctgccccgggaaggcccggggggcgggggcggagacggggctgctgggtgcgtgcgggatgccgggtgcgcgggagcttcccgcgtgggacgttccggtcgcccgggaggcggacgccgggtgtgcgccggcgccggtggcggagcccccggtggcgagcgcgccggccgcggcgagccccgcgcccgcgcgcagcgccgagcgccggttcggcgccgcgcgcacgacgactgtcgcactgtccggctcactgtccggctgagggaggggggcgggcgtggtcacccgcaccatttaagggcgaatgatgctgaaaaccgatgattggaccgtttgacggggatgcgggtcgctcggccgcggcgccctccggggacacagaagccccgaccgctgggcggccggggctcttgcgggcgtcgcggaacgagttggggtgtgaaccacggcgcctgcgacgaccgtggcccgggtcaatgggtggatgtcgcgtgttcgactatcgcagaccagtcggttgatccaaaagcgattcccccacggattcgcacacggaaccgaatctgtggggcaactgcgggcgggcgtcagcggtcggcgacgcgcatctcgaaccaggtcgtcttgccgcgcggcagcagatcgacgccccagcggtcggcgagcgtgtcgacgaggaagagaccacggccgctcagatccatctcctgaacgggcatcagacagggcaggccgcgggaggggtcgcggacctcgatacggatccacccgcggcggcggcgcatccggagtccgaagacgcgtgcgccggtgtgccgtactgcgttgccgacgagttccgagacgagcagcaccgcgtcctcggtcatcttcggcgagagcccccagtggcgcagcacgacgacttgcgcgagccgtcgtgccgtggccgcggactccgggcgggacggcagcggcacctccgcctccgccgggttgccgaacagctccagtgccttgagcgcccgttcatcctcgaccgcgggcgaccagcgtgccgcggtcgcactcgcgtgctgccgcggcggttcgataccctccagccccgccatgcctccatgatggccgcccggaggggccttggggggcgttccgaaggaatacaccccccggaatcccccattccgcaccattcggaaggcatatgccagaagcaattcaggggcgtccgcggcccaactgacctgcgaaaacgacccccttcagggcaatcgcccgagccccccgacaaggcggacttaaggttgcgttaaggctcccataaaccgccccttcgggggacccgggtgagacatcgcgtcaactgcaaggggatcagcggaatttggtgaacaattttcacctctgatccgggccccggtccgcgccctgatccaagctccggtccgagccccggtccgagcccctcagaggaacttcgccttgcccggcccttcctccacgaagctgcgcatcccgcgctcacggtcctccgtggcgaacaggcccgcgaaccagttccgttcgaccgcgagtccggtgtcgatgtccgtctccaggccgacgtcgatcgactccttcgccgcccgcagcgcgagggccgggccctgcgccagcttcgcggcccaggcgtgcgcctgctcgtacacctccccgaccggaaccacccggtcgaccaggccgagcgccagcgcctcgtccgccttgaccatccggcccgtgaagatcaggtccttggcgcgcgagggaccgatcagccgggacaggcgctgggtgccgcccgcgcccggaatcaggccgagcaggatctccggctggccgagcttcgcgttctcggcggcgatgcggtagtccgcgcagagcgccagttcgcagcccccgcccagcgcgtacccggtgacggcggcgacgaccggcttggggatgcgggtgacggcggtgaaggagtcctgcaaggcccgggagcgtacgaccatcgccgtatggtccatggcctgcatctccttgatgtccgcgcccgccgcgaacaccttctccccgccgtacagcaccaccgcgcgcacgtcctcgcggcgcgtggcctcttcggcgagttccttgagccggtcctgggtggcgacgtccagcgcgttcatcggcggacggtcgaggcggatggtgccgacgccctcggcgacttcgagatgcacagtcatgaaggaaggttaacggcgactaacgacaacgggcccggtgtgctgagtcacagcacaccgggcccgtaccgcacgagcgcttacgcgatccacttctcccaggacatgttccagccgttgagcccgttgtcgggcgcgaccgtccggtcgtgggagttcttcacgatcaccacgtcgccgatcatcgagtggtcgaagaaccagccggccggcacactgcggtcgccgccgccgcgcacgtcgcgcagccctatgcagccgtggctggcgttgtagttgccgaaggcgccgccaccccagtagttgccgtggatgaaggtgccggagttggtcaggcgctgggcgtcgggcacgtccttgatgtcgtactcgccgccgtagccgaccgtctcaccgttcatccgggtcacccgcaggcgctcgctgatgaccatctggccgttccaggtgtcgtagcccggcttgccggtggtgatggggatcgtcttgtagaccttgccgtcgcgcttgacgaccatcttgtgggtcttggcgtcgaccgtggagacctggtcgcggccgatcgtgaaggtgacggtcttggcctgcttgccgtagacgccgggccggccctcgacgccgtcgaggttgaggttcacggtgaccttggtgccggacttccagtactcctggggacggaagtcgaggcggtcgttgccgaaccagtggcccttgacgtcgacggccggctcggtcttgatggtgatcgccttctcgacgtcctccgggtgcgtgataccccgggtgaagtggacggagaacggcatgcccacaccgaccttggcgccgttgtcgggcgtgtagatgccgacgaaggtgttcttcggggtcagcgtggtgaacgcggactcctcggcggactcgtgtccgtcggcgtccttcgccaccgcgtggaccttgtacttggtggccgaggcgaggtgggtcgagggcgtccagccggcgcccccgccggttatcttgccgtcgaccggattgcccttggtgtcctcgaccttgacctcggtcagcttgcccttggccgcggtcaccttgagggcgccgctggtcgccacgtcgtcggcgccgtccttcggggcgatcgtcacgacggcctgcgaggacttggtgtccgcctgcccggagtccttgcccttgccgtcgcctgacccggagtccgagcctccgcccccgccgcacgcagtcaccgcgagcagcagaacgcccagcagcagtgccaggattcccttgctccggtggctgtgcgcgtcaaccgacgcccccgatatcggtcgcccgttcacgatccttctcccctcgcacggcctgatgaggcccgcactccagcgcgacccgtgcgcgcactgcgcaaattaatcacacggcccggcccgatgactccccgcgattgtcactgttcagtcccaacttcaactgaaccagcgcccgctggagtccgctggagttcgtctgcgcgcgtacccctttgtcgggctacttcaccgcggcgcccgctttccactccttccagcccatgttccaccctccgaggccgttgtcgggagcgacctttttgtcattgctgcggacgacctccacgacgtcaccgatcagggtgcggtcgaagaaccagcccgccggggtgtccgagctgccgcccttcacatcgcgcaggcccacacagccgtggctgacattggtgttgccgaaggcgtccggcgcccagtagttgccgtgcaggaaggttccggaggcggtgaggcggatggcgtgcgggacgtccgggatgtcgtactccccgccgaagccgaccgtgcggctgttcatacgggtcacttccagcatctccatgaccaccatcttcccgttgtacgtcgtcgtcttcggggcgcccgcggtgatcggaacggtggcgagcagctcgccctcgcggcggacctccatggtgtgctcgaccgcgtcgacgagcgagacctggtcgcggcccacggagaaggagacggtcttgtactggagtccgtagacgccgggcgcgccctccacgtcccgcaggttcagcccgacggtgaccttggtgccgggcttccagtactcctggggccggaagtcgaggcggtccttgccgaaccagtgcgggcggatctccacggccggcttggcactcacacggatcgcgcgttcgacggcggcccggttcacgatctcccggttgaactccagggagacgatcattccggtgccgacggtcgaccggttctcgggagtgacgtacccgatgaaccgctcgtcggggacgaaggtggtgaaggtcgtgtggcgcgcggagcggtgtccgcgctcgtcgagggcgaccgcgtcgacccggtacttggcggcgagcgccagccgcttgtcgtcgggctgccagctctggccgtcgccggagatgtggccgggcaccggggagtcctgtgcgtcctgggacttgacgaccttcaccgattcgagccggccgccgggcacccgcaccttcagcggctggtcggcgtgtacggccttgctgtcgtcgtccggccagacgtggatcacatcctcggccgcagggggtttgccgaacacctcgtcgactccgtgggagattccgggggaagtgcaggcggaggcgccggccaacaggcccgcccaggtcagtacggcggccagggcggcccctgcgcgccgcgcgcgccgtgtctgtacatgcatcacgacgggcccaacgaccgtgcccctcctggggaaacgtgagtgcgaggcaagctctgggcagaacagtggggaggacgacgcgacagggagccgcggccgggacgccgtgcgcccttttccacgccgtcccacggagccgcgggaggccgaccggtgtcgagcgcagccgagcaggaggcagtacaggaggagcgcgcgggtgaagaacatgccgcgcgcccggccgccgtgctgaacggcaggcggcccgcggcgcccgccccacccgtgtggccgggcgcccccaccccgctcggagcgcgcttcaggaccgggcccgacggggtgacgggcaccaacttcgccctgtgggcgggcggcgcggaggcggtcgagctgtgcctgttcgacgagacgggcgcggagatccgcgtcccgctcaccgaactcacgcacgagatctggcacggcttcgtccccggtgtactgcccgggcgccgctacggctatcgggtgcacggccgctgggacccgtggacgggcgcccgctggaacccggcgaagctgctcctcgacccgtacgcgcgcgcggtcgacggcgacttcagcctgccgccggaggtgtacgggcacgtccgggactggccgcagcagcaggtcgcggacaccgtgcgcgacgaccgggactcggcgccgtacgtccccaagggcgtcgtcgtccacgatgacgacgactgggcggacgaccaccgtccgaagacgccgtgggcggactcggtgatctacgagctgcacgtacggggattcacgaagacgcatcccgggatcccggaggaactgcgcggcacctacgcgggactggcgcacccggcggcgatcgaacacctcgtcggactcggcgtgacggccgtcgagctgcttccggtgcaccagttcgcccacgaggaccacctgctgcgcaagggcctgcgcaactactggggctacaactcgatcggctacttcgccccgcacgccggctacgcggccgccgggacgaacggacagcaggtcggtgagttcaagcggatggtgcgcgccctgcacgcggccgggatcgaggtcatcctcgacgtggtctacaaccacaccgcggaggcgggcgaactgggcccgacgctctcgctgaaggggatcgacaaccggggctactaccgcctccagcccgacgcccgccggtacgcggactacacgggctgcggaaacacgctgcacgtggtgcagccgcacgtcctgcgcctgatcacggactcgctgcggtactgggtgacggagatgggcgtggacggcttccggttcgacctggccgcggccctggcccgatcgatgcacgacgtcgacatgctctccccgttcctcgcggtcatcgcacaggacccggtgctgcgccgggtgaagctgatcgcggaaccgtgggacgtcggctccggcggctaccaggtgggcgcgttccctcccctgtggacggagtggaacgaccgctaccggggcgccgtacgggacttctggcgaggcgcgctgccggacgtgcgggacctgggctaccggctgtcggggtcgagcgacctgtacgcgtggggcggccgtcggccctacgcgtccgtcaacttcgtgacggcccacgacggtttcacgctccgggacctcgtgtcgtacgagcgcaagcacaacgaggcgaacggcgagggcaaccgggacggcagcgacgacaaccgggcgtggaactgcggggcggagggcgagacggacgacgagcgcgtacggtccctgcgccgccgtcagctgcggaacctcctgaccaccctgctcctgtcgacgggcgtgccgatgctggtcgcgggcgacgagctggggcgcacgcagcgcgggaacaacaacgcctactgccaggacaacgagatcagctgggtggactgggaactgctggaggagcccggctggcgggcgctgcgcgacctcaccgcccggctgatcgcactgcggcacgcccatcccgtgctgcggcggcgcgcgttcttctccgggcgggcgcattcggcggacggcctgcgggacctggcgtggttcacgccgcgcggggcggagatgacggaacgggactggtacgcaccggcggcgacgctcggcatgtatctgtccgggcgggacataccggggcgcgacgctcggggcgtgccggtggtggacgacagcttcctcgcggtgctgcacgccggacaccggccggtgagcttcgtactgcccgggccgccgtgggccgagcggtacgaggtcgtcgtcgacacctcccgcgaggaccaggccgcggcaccggggacggcgcaccgggcgggggcgacggtcacggtcgcggcccgggcggtgctgttgctgcgggtggggtgagcgcggccgccggcgccgacgggtgaacggcgtcggccgatcggtcgatggtgcggtacgccccttgtgggcagccggggttcgatccctcgaacgtgcaggtcccaggaccggcggccgcctctggtccggccaaaactcggtgggcgctgtcagtgccgaaccgtaggctcgctcctgatgtccaccacactcgcagccgccgaagaccgctccgaccacgccggccgttcgtccgtgcgcactctcctgcgcctgtggccgtatgtgcggccggtgcgcgtacggctgttcaccgccgccctcgtggcggtcgtggcctcctgtacgggcctggtcatcccgctcgtcctgaagtggctggtggacgggccggtggcggaccgggacacccgtggcatctggctcggggcgctgtatctgctgctgctcgggttcgccgaggcgctgctgttcgggctgcggcgctggctggtggcgcggccgctgtcgcgggtcgaggcggacatgcgggcggatctgtaccgccatctccaacggcttccggtcgccttccacgaccgctgggcctccggccagctgctgtcgcggggcacgacggatctgatgctgctgcggatgttcctcgcgttcccactgacgttcctgctggtcaacggcgtgacgatcctcgtcggcgtgatcatcatgctggttcaggactggacgctcgggctggtgatcctgggcccggccatccccgtggtgatcatgtgcgcgctgttcgagcggcggtacgcggaggtggcgcggcgggcgcaggaccaggtgggcgatctgacgacggtggtcgaggagagcgtgctcggcatccgcatcgtcaagggcttcggccgccaccgcagccaggcccgcgcgttccgtgagctgacccggaccctgcgcggcacggagctggcgaaggcccggctgctcgccgcgatctgggcggtcatcgtcaccctcccggaactggccatcggcgcggcactcgtcctcggcacgatccaggtggccgatggggacctgtcggcgggcaccctggtcgcgttcctgtccacggccctggccctgcgctggcccgtcgactcgatcggcttcctcctcgcgatgagccaggaggcggcgacggcgacggagcggtatttcgaggtgatggacgcggaaccggagtcggccgacgccgtcgccgccccggccgccccggccggcgccgacggcctgcggttccacgacgtccgcttccgctaccccgacgcgccctcggacgcgccgcccgtcctcgaccgcgtcgacctccacatccgccccggcgagacgatggccctggtcggcgccaccggcaccgggaagaccaccctgaccgcgctcatcccccgcctgcacgaggtcacgtcgggccggatcaccctggacggcgcggacatcacggccatgccccggcaggcgctgcgcgaactcgtcgccgtcgccttcgaggagcccaccctcttctcggcgaccgtcggcgagaacgtcctgatgggtgccgacgacagcgcgggcgagcaggagctggaccgcgccctcgccgtcgcccaggccgacttcgcgcacgccctcccgcagggcaccgccacccaggtcggcgagcagggcctcagtctctccggcggccagcgtcagcgcctcgccctggccagggcggtcgtgggccgcccccgcttcctcgttctcgacgaccccctgtccgccctggacgtccacacggaggccgccgtcgaggccgccctgcgccgggtgctcgccgagaccaccgccctggtcgtggcgcaccgcccgtccacggtgctgctcgccgaccgtgtcgcgctgctctccggcggccgcatcgccgccgtcggcacccaccaggaactgctgcgcacgaacgccgagtacgcccatctgatgtccggggcggaccgtgcggaggaagcggaggaagcagagaaagcggaggaagcagaggaattggaggccgaccgatgacggcgccgacgacgaccgcgcccgacctgaccgacgacggcgaggaccccgtcggcacaccgggcggcggcgaccccttcgaccgggacaccctccccacgcccccgggcgcgacgggcgccctgctgcgctcgctgctggcaccgctcagggcccgcgtcgtcgtgacgagcgggctgctcctgctccagcaggcggcggtgcagctgggcccgctgctggtcgcctacgccatcgacagcgccgtaccggcgttccggcgcgacgaccacggcccgctgatcgcggtgggagtggcgtatctgctgtgcgcggcgctctccggcggcctccagtacgcgttcatcctggcgtccgcgcgcgtcaaccaggacgtgctgctcgacctgcgcggccggatcttccgccatgcgcaggccctgagcatcgacttccacgagcgctacacctcggggcggctgatctcccgctcgacgacggatgtcgagtcgctgcgcgagctgctcagcgagggccttcaggaactgatcgcggtcatcctgtcgttcgtctacatctcggcgatgctgctgtggctggacctgggcctgggcgcggtggcggtcgcctcgttcgggccgctgtatctgctcgtacggctctaccggcgccgtgcgggacgggtgtaccgcctgcgttcgacggcgatcgcggcggtcatcgtgaagttcgcggagacgatgaacggcatccggccggtgcgcgcgttccgccgcgaagcggtgaacgacgcggacttccgcgtgctgaacggacgccaccagcgcaccaacggcgacgctttgctggagatggcccgctatgtcaccggctcccgtctggtggccaacacggcggtggcggggatcgtgctgtggggcgcgtaccgggtgtcgtcgggctcgctggagctgggcgtgctcgcggccgccgtgctctatctccgccggctgtacgaccccatcgaccggctcggcatgttcctcaactcgtaccagtcggcggcggcctcgctggagaagatcgcggggctgctggcgcagacgccgtcggtgccggagccctccgagccgcgcgccctgcccgccctggagtccgcgcaccccggccgcgaggtcgtgttcgacgccgtccgcttcacgtaccgcacgggcggggaggtgctgcccaccttctcgctgacgctgcccgccgggcagacggtcgccgtggtcggctcgaccggcgccggcaagtcgaccctcgccaagctgctcgcccgcttctacgacccctccgccgggcgggtgctgctggacggggtcgacctgcgcgagctgacggttcccgagctgcggcgcggtgtggtgatggtgacgcaggaggcgttcctgttctccggcacggtcgccgagaacatcgccatcggtcgccccgacgcgacccgggaggagatcgagcgggccgcgaaggcgatcggcgcccacgacttcatcagtgcgctgccggacggctacgacacggacgtccgcaagcggggcgggcgcatctccgcgggccagcgccagctggtcgcgttcgcacgggcgttgctggccgacccggcggtgctgatcctcgacgaggcgaccagctcgctggacgttcccggtgaacgggcggtgcagcgggcgatgctgacggtactgaagggccggacggcggtcgtgatcgcgcaccggctgtcgacggtggagatcgcggaccgggtactggtcatggagcacggccggatcgtcgaggacggcagcccggccgaacttgtcgcgggcacgggccggttcgcggatctgcaccgggcctggcgggacagcctggtgtgacgggcaggagctggggggcggatgatcgacgcgtacgaggacccgggggacccggactgtcgcggtggcggccggtatctgtggtggctggtcatgcggcagcggggccggtgcgccgccggggcgctgttcggcagtacgtggatggtgctgctggcggcgacgccgtatctgatgtcccgcgcgatcgacgacgggctggcaccgggcgaccggaccgcgctgatcggctggacggcggccctgttcgcggtcggggcgttcaacgcctggctgagcatcatgcggcaccgcacgatgacccgggtccggatggacgccaacttccgcaccgtcaaggtcgtcgtcgggcaggcggtccggctgggcgccgcgctgtcgcgtcaggtcggggccggggaggtcgtcacgatcggcgtgggcgacgtccagacgatcagccagtccctgaccgtcgtcggccccggcgtcggtgcggtcgtcgcctacacggtcgtcgccgggctgctgctgtccgtctcgccgccactggccgcggtggtgctgctcggggtgccgctgatcgccgtgctcgtcggtccgctgatggggcggcttcagggcgcggagacggagtaccgcgagcggcagggcgtgctgaccgagcggatcggggacctcgcgggcggtctgcgggtcctcaacggcctgggcggcaaggggctgttcgcggacgcgttccgccgggactcgcggcggctgcgggagcagggctaccgggtcggggcggtgaccagctggatcgaggcgctcggggtgggcctgccgacgctgttcctcgccgtggtgacctggctggcggcccggctggccgcgcgcggggacatcacggtgggcgagttggtgtcggtgtacggctatgtcgcggtcctggtggggccggtggcgttcttcatcgagtgcggctaccagctcagccggggcgtggtggccgcgcggcgcgtcgtgcgcttcctgagccttgcgcccctcgcggacgacggcacggccgacgcgcccgcggagccgtccgtgctgtccgacccggagtccggggtccgggtggtgccgggccggctgaccgcgctcgccggggcccgccccgccgatgccgcggaggtggtcgaccgcctcggccggtacgcgccgtcggccgccacctggggcggggtgcggctcgacgccgtcgcgctggggcaggtccgcgagcggatcctggtcgccgacaacgaggccgatctgttcgcgggtccgctgcgcgatctggtgggcggcagacggggaccggacggctgggacgaggcggccctcgcgcgggccgtgcacgcggccgcggccgacgacatcgtcctcggtctgccggacgggctcgagacggccgtgaccgcgcagggccgcaccctctccggcggccagcggcagcgcgtacggctggcgcgggcgctgctggccgaccccgaggtgctgctggccgtcgagcccacctccgcgctcgacgcccacaccgaggccaccgtggcggaccggctgcacaccgcgcgcagcggccgtacgaccgtcgtgaccaccacctctcccctcgtgctcgcccgggcggacaccgtgtactacctggtcgacgggaaggtggccgcgaggggcagccatcgcgaactcctgggcggggagcccgggtaccgggcgctggtggcccgggacgcggacgccgaggaggccctgcggtgacgaccggaacttctggacacctgcccgtcgcggaaccggccggtgtgcggcgggccgccgtccgtctggtccgggccgacgggcgcgccttcgccgccgtgctggtcctgaacgcgctggccgcgggcgccgggctggccgggccgtggctgctcgggcgcatcgtcgacggggtcggggccggaggcggggtgcgggccgtggaccggctggcgctgggcatcctgctgtgctccctcgcgcagctgctgctggcccgctgggcccggtacgtggggcaccgcttcggggagcggacgctcgcccgggtgcgcgaggagttcgtcgaccggacgctggcgctgcccgcgtcggtcgtggagcgggcgggcaccggcgatctgacggcccgtggcaccgccgacgtggccgccgtcggcaccaccttgcgcgatgtcggacccgatctgctcatccacaccctcgaggcgctgttcctcctcggtgcggtgttcgtcctcgccccgctgctgggcgccttcggcgtgctcggtctgaccggcatctggtgcgcgctgcgctggtatctgcggcgggcccgggacggctatctcgccgagggcgcggccacctcggaggtcgccgagatcctcgcggcgacggcgtcgggggcccgtaccgtcgaggcgttcgggcttcaggagcggcggatcggcgcgagccgggaggcgctggagacgtcccggcgcacccggctgtacacgctgtatctgcgcaccgtgttcttcccggtggtggaggtgtcgtacatcgtgcccgtggccggggtgctgctgatcggcggtgcgctgcacgcgcggggtgtgatgagcctgggtgcggtggtggcggcggcgctgtatctgcgccagctcggcgaaccgctcgaccagatcctgatgcgggtcgagcagttgcagagcagcggcgcctccttcgcccgggtggagggcctggcccgggcgccgcggagcggtccggccgactcggccgcgccggcggacgaccggatcgacgtgaccggggtgcgctacgcgtacgagcgtgggggcgaggtgctgcgcggcgtcgacctgaccgtgcgtcccggggagcggctggccgtcgtcggcccgtccggcgccggcaagaccacactgagcaggctgctcgcgggcgtcgacgcgccgagcgcgggcacggtgacggtgggcggggtgccggtcgtcggcctcgagccggagcggctgcgccggcaggtcgtcctcgtcacccaggagcaccatgtcttcctcggcacggtccgcgacaacctgctgatcgccgagccctcggccacggacgacgcgttgtgggcggctctcgccgcggtcggcgccgacggctgggtgcgcgagctgccggacggcctcggcaccgtcctggggtccggtggttgtgccacggacggctcacaggctcagcaactggcgctggcccgggtggtgctggcggatccgcacacgctgatcctcgacgaggccaccgcgctgctggatccgacgaccgcccgccacaccgagcgcgcgctggcggccgtactcgaagggcggaccgtcatcgccatcgcccaccggctgcacacggcgcacgacgcggaccgggtggccgtgatggaggacggccggctgaccgaactcggcacccacgaggccctggtggcggcggggggcgcgtacgcggcgctgtggcattcgtggcacggcgacgagccgtccccgtcctgaatccgggatcgtcgggcggccttgtacgcctttgcgacggtctccggcaggacactcctgaccggacttctgaacggacttctgaccggacttctgaacggtccgtataccgaacatgacttaccggacaacggacgatttccggccaaatccttgatgcgcccctgacagaaagcgcggtctcctgacactcttcccacggccacctcacagcaagcacacagctcgaccgctgtgccgcggccgtgcgttccccatgcaccaccccgagcaccacccatgcaccaccccatgtacctggttccgcgtaacgccaagttccgccctgttctgcccggacgggtgaccatcgtccggtctcccctggccgcgcgacccgcggccacgcagaaggagtcagtgttgagtagcagttcctcccacagacgcacctcccacatcctgcgtcgtcgcgccggggcagtcgccctggtgggcgtcaccgccctgctcgccgcggccgtccagtcgggcgccgccaacgccgcccccgaccaggcccccacgggcaaggtcaagccgggcgccgtcaccctgaagctcaccccgtcccagcgcgccgagctgatacgcgacgccaacgcggccaaggcggacaccgccaaggatctgggcctcggagccaaggagaagctcgtcgcccgcgatgtcctcaaggaccacgacggcacggtccacacccgctacgagcgcacctacgacggactgccggtcctcggcggcgacctggtcgtggacacctcgaagtcgggcaagaccgagcgggtcgtcaaggcgacgaaggcggccatcaagccggcctccctcaagccgcagatcgcctccgccaaggccgagcagcaggccctgaccgccgccaagtccgccggttcgaagagcaccaaggcggaccgcgcgccccgcaaggtgatctgggcggccgacggcaagccgaccctcgcctacgagaccgtcgtcggcggcctccaggacgacggcaccccgaaccagctgcacgtcatcaccgacgcggccaccggcaagaagctctaccagtaccagggcatcaagaacggcatcggcaacacccagtacagcggccaggtgaccctgacgaccacacagtcgggctccacctacacgctgaacgacggagcgcgcggcgcccacaagacgtacaacctgaaccacgggtcgtccggcaccggcacgctgttctcgcagacgaacgacacctggggcaacggcaccacgtcgaacgccgcgaccgccggcgccgacgcgcactacggcgccgccacgacctgggacttctacaagaccacgttcggccgcagcggcatcaagaacaacggcgtcggcgcgtactcgcgggtccactacggcaacgcgtacgtcaacgccttctgggacgacagctgcttctgcatgacgtacggcgacggctccggcaacgccgacccgctgacctcgctggacgtggcgggccacgagatgagccacggcgtcacctcgaacacggccaacctgaactacagcggtgagtccggaggcctgaacgaggcgacctccgacatcttcggcacgggcgtggagttcttcgcggcgaactcctccgacgtcggtgactacctcatcggcgagaagatcgacatcaacggcgacggcaccccgctgcgctaccaggacaagcccagcaaggacggcgcgtccaaggacagctggtactcgggcatcggctcgatcgacgtccactactcgtcgggtcccgcgaaccacttcttctatctgctgagcgagggcagcggcgccaaggtcatcaacggcgtcagctacaactcgccgacgtcggacggccttccggtcaccggcatcggccgcgacaaggccctgcagatctggtaccgggcactcaccaccaagttcacctcgaccaccaactacgcggcggcccgcaccggcaccctcgcggcggcgggtgagctgtacggcacgacgagcaccgagtacaaggcggtgcaggacgcgtgggcggccgtcgcggtcggtgcgcgctccggtggcggcggcggtggcggtacctcgtacgagagcacgaccaaggtatcgattccggacaacgcgggggcggtgacgtcctcgatcaccgtcacgggccgcaccggaaacgcgccgagcaatcttcaggtcaccccgaacatcacgcacacctggcgtggtgacctggtcatcgacctggtggccccggacggctcgacgtaccgcctgaagaacttcagctcgtccgactccgcggacaacgtgaccgacacctacacggtcaacgcgtcctccgaaaccgccaacggcacttggcagttgaaggtccaggaccaggcggcgcaggacgtcggcaccatcaacagctggaagctgacgttcccgtagaccccgcttgacgcagggcacaggacagggcgtcgccccggtggttcaactccccggggcggcgccccctttgctgtgccctgacctctccttggttgccgccatacccaagatcaggtccgcattgcgtacacggatcttcacccaacggacgattttcagccaacgttcctttggggtcatgacatgtacgcgccctaggtgtcactcttccaccgcacggctcacccgcaccgcaacttcacccgtccgtacggctaccccacgtcgttcggccgcccccacaaaggagcttgcgtgacctccctctacgcgcgtcacaagcgcaccactctggccatcgccaccgctgtcgccgccggagccctgctcgccaccggtgtgaccaccggtgcctctgcccagaccccggtgtccgacgccggcaagaaggccaccctcgccggcgccccgctccagctgtccgcggcggcgcgcacgtccctcatcaagaaggccgaagccgccacgccggagacggcccagcagataggcctcggcaccaaggagaagctggtcgtcagagacgtcgtcaaggacgccgacggcacgctgcacacgcgctacgagcgcacgtacaacggactgccggtcctcggcggcgacctggtcgtccaccagtcgaagtcgggcacgaccgagggcgtgaccaaggcgacgaaggcgaccatcaaggtggcctccctcaagccgcagatcacctccgccaaggccgagaagcaggccctgaccgtcgccaagtccgccggctcggagaagacctcggccgaccgggcgccgcgcaaggtgatctgggcgggcaacggcaagccgaccctcgccttcgagaccgtcgtgggcggcctccaggacgacggcaccccgaaccagctgcacgtcatcaccgacgcggccaccggcaagaagctctacgagtaccaggccatcgagaccggcaccggcaagaccctctactcgggcacggtcaccctcaacaccacgctgtcggggtcgacgtaccagctgaccgacgggacgcgcggcagccacaagacgtacaacaagtcgcacaccaccacctcctccgcgggcaccttgttcaccgacgcggacgacacgtggggcaccggcgcggcctccagctccaccaccgaccagaccgcggccgccgacgccgcgtacggcgcgcaggtgacgtgggacttctacaagaacaccttcggccgcagcggcatcaagaacaacggcgtcgccgcctactcccgcgtccactacggcaacgcgtacgtcaacgcgttctgggacgacagctgcttctgcatgacctacggcgacggctcgggcaacacccacccgctgacctcgctggacgtcgcgggccacgagatgagccacggcgtcaccgccaacaccgcgggcctcaactacagcggtgagtccggcggcctgaacgaggcgacctccgacatcttcggcacgggcgtcgagttctacgcggccaactcgtccgacgtcggcgactacctcatcggcgagaagatcaacatcaacggcgacggcaccccgctgcgctacatggacaagcccagcaaggacggcggctcggcggactcctggtcctccagcgtgggcaacctcgacgtgcactactcgtcgggtgtcgcgaaccacttcttctacctcctctcggagggcagcggttcgaagacgatcaacggggtcacctacaactcccccacgtccaacggctccacggtcacgggcatcggccgggccaaggccctgcagatctggtacaaggctctgacgacgtacttcacgtcgacgaccaagtacgcggccgcccgcacgggcaccctctcggcggcctcggcgctgtacggctccaccagcaccgagtacaaggcggtggcggcggcctggtcggcggtcaacgtcagctagtcgactggccggctggtcgactgatcgactgatcggccgtatttcgcacagggcggcacccggagagaaggtgactccgggtgccgccctaggctgtgccccatgtccttcacgtacgaggatgtcggcgcgacccgtgagaacgggtactgcccgccgggattccactccctgcacgtgcgcacgcgcataggcgagggcgaagaggtgttccgccgggcgtcccacgcggtcgtcacctgggagatgcaccgcgccatgggcgtcggtattgacgcgtccgcggacgcggccgccccgggggtcgacgtcacggtctccctggccggcatgatcaaggccccgtgccgggtggtctggacggtcgacgaaccccgccgcgccggctgggcgtacggcacgctttccggccaccccgagtgcggcgaagaagccttcgtcgtgaacagaacgggcgacggcacggtctggctcacgatcacggccttcagccgcgcggccaagtggtacgcccgagcgggcggcgcggcgacgcgaggcttgcagcacgcgtacgcgcggcggtgcggggtggtgctgcggaggctgtgcgagtcggttgcggactgagtgcccgactcgcccgtcctacacgcggcgctccgccaccgccctcctccttcccacttcgaaccacagcagcttcccggcaccgtgccccatctggtcatcgccgaggcgccagccgccccaccagtccgcgtactcctgtacgaggaagagaccgcgcccaccaacggcgtccaccggcgcgcacgggacacggtctccgggcggccggtcgaagggggcaggaatgtgcggactgctgtcccacacaccgacccgcaaccgtcctcctcccagcgccgtcagccgcagggatgcaggccctttggcgtaccggtaggcgttggtgacgagctcggaggtcaacagctcgacgacatcgacgacttcacccataccgtgcccggacagcgtggcccgcacggtcatacgtgcgacgcgtgcggcgcgggggtcatggggcaggcgaagggcgtatacccaggtgtcgggcggggttacggtgaccatgaacggctccggagtggaaggggcttgggctcgctcgacggcagcgccgcgcggtggcagtgccagggctgtggtgcgcttccggcttatcggcgcgggaggttgagcgacgtgggacacaccatagagggcgtgatgtgatacttaacatcgaacgaaggtgatgattcataattccctcctgtgggtgacccgcaggaacacaccgccgagagagggcccagtgccgcccagcaccactcccacactgcgccaacaacgactgggctccgagctgcgcaggctcagggagcactcaggactgacatccaccgctgccgcggacctgcttggcctcaagcaggctcaggtcagcagcatcgaggccggccgctacgccgtcagcgccgaccgcgtacgcaccttcgcccgcacatacagctgcgccgacccggctctgatcgaggcgctggccgagatgaccgggggccgtacccggggttggtgggacgagtaccgggagtatctgcccgccggattggccgatctcgccgaactggagcaccacgcaaccgagttgcgcgtggccctgtccctgcacatccctgccctgctccagaccacggaccacgcccgagccatgctccgcgaagcggtcccgcccttcctgccgtacgagctcgagcaccgcctgtcgtaccgcatcaagcggcaggagatcctgaaccgctcggccccactcccctacacggcacttctgcatgaggcggccctgcgcatgcagtacgggggcgcggacgtcgcccgggatcagctcgcccacctgctggagcggagcgagcaggacaacatcaccatccgcgtcatccccttcacctcgccgcatttccccggcaacggccagtccttcgactacgcggtcggcccgaccccccagctcgacacggtccaactggacacccaccacggcggctgcgaattcctggacacggaagcacagttggcgaaataccggaccgtgctggaccgcatggaaaactgcgctctcgaacccgccgagtcacgcaagttcatcgagcacatcatgcaaagccactgaaaggggccgacgtgcacatatccgcctggcagaagtccacctacagccccgacggctcgaactgcgtctacgtcgccgccacccccaccggaaccgttcacctccgcgaaagcgacgaccctgacgtcatcctgaccaccacccgcaacccgctgctctccctcatacgctccctcaaagaagacagccaacgacgctgacaccccaaacagctgacccaggcgccctgggccgccggttcggtgtcgcacaactctcagagctgcaatacagccggaagattcttagggtttccataagtcaggattctatttctcgcccactgccaaccaccttgcccacacgcagagcgaattgcatggacccaaagaaagcctcccccgtaccgctactgcaagaaaatttatactcgccctcacggaccacatcgcagatcattccagcgtttccgagccatgccgcacgctcgccgaacttgccccgccaacagttccagacttgaagggtagaacccttctcggcgttgactcccatatcaacgacagatggcgccgcatccatccaaaataccaacccggggtgcgaccttccttcaaccgaaagcaccccttcgccgacctgaaggcagaccccctgaaccggctcatcgacaaagccggagaactcgagtcgaatcttggaagtctctactcctacgggaattcgataggccatatggatcatttcgccatcgcgttcgacaggacggccgcccgactcctggaatagttcatccagcttgcgaggagcagctgcaccgttcattaggttctcttttcagacatctacctgtgggtcaggctcgtcgacccgtcggccggctcgtccgcggtcgtcgtagaggttcagggaccccagtcgtccgccgactggggtcggggtctgaacctggcggctacgcagcagtgagtcgtgaaactcgtatgcgtagccgtgcccttgagggtgtcaccgcagcaaaaccccagccccctcccccacatcctccgatggcaccgccaccagccccagttccgcgctcgtcgccaggaggcggtgggtcggcaggatgcggaccgtgtagccgaaggggcccgtgcggtccagggacagggggccctcgtacacccgtcgtccctccaggtccgggccgcccaccggtttcagggggaccgccgtcgcgtccgtgatgcggtcctgcccgtccacccggcccgcgaccgcctggacctcgacgtcgtccgggtcgaggtcgccgaggcccacgcggacccgtagtgacagcgtcgtgcccagctccgccgtcgtcgtcgccaccgaggtctccacatggtcgacggtgacccgcggccaggccgcccgtacccgggacttccaggtcgcgagctcccgtgccggttccggggtcagcgcccggtgcgcgagggccgcgggggtgtagagacgctccacgtactcgcgcaccatgcgccccgccagcaccttgggacccagatgcgtcagtgtctggcggaccatctcgatccagcggtcgggcagaccggcctggccccgctcgtagaagcggggggcgacgcgcccttccagcaggtcgtacagtgccgtcgcctccaggtcgtcccggcggtcctcgtccgtcgcggtgccgtccgccgtcgggatcgcccagccgaagtccggctggaaccactcgtcccaccagccgtcgagcaccgaaaggttcaggcagccgttgagcgcggccttcatcccgctcgtcccgcacgcctccagcgggcgcagcgggttgttcagccagatgtcgcagcccgggtacagcttctgcgccatcgccatcccgtagtccggcaggaacacgatgcggtgccggacgcgcgggtcgtcagcgaaccgcaccagctcctggaccaggcgtttcccgccgtcgtccgccgggtgcgccttgcccgccaccacgatctgcaccgggcgctcggggtgcagcagcaggtccatcagccggtcccggtcccgcagcatcagcgtcagccgcttgtacgaggggacccggcgcgcgaagccgatcgtcaggacgtccgggtcgagcaccccgtcgatccagccgagttcggccgtgcccgccccgcgctgccgccaggacgcgcgcagccgctcccgcacctcggtcaccagttgctcccgcagcacccgccgcaggtcccagatgtcctggtccggaatctccgccaccgcgtcccagcgctccgagccgcccaccgtcatcgcgtcctcggtgcgctgggcgccgatctgccgcgcccccagccggaacacctccggggccacccaggtcggcgcgtgcaccccgttggtcaccgaggtgatcggcacctcgtccgggtcgaagcccggccacaggcccgagaacatctcccggctcacctgaccgtgcagcagcgagacgccattggcgcgctggcccagccgcaggcccatcaccgccatgttgaagaggttgggttcgccgcccgggtacgtctccatgccgagccccaggatccgctccacgtcgatcctcggaagttccgcgtccgggccgaagtggcgggccaccagctcccggtcgaaccggtcgatgccggccgggaccggcgtgtgggtcgtgaagaccgtccccgcccgcaccgactccaggcccgcgtcgaagtccagccccgtgtcgcagagttcggcgatccgctccaggccgaggaaacccgcgtgcccctcgttggtgtggaagacctccggctcggcatgaccggtcagccggcagtacgtgcggaccgcgcgcaccccgccgatgcccagcagcatctcctggagcagccggtgctcgctgccgccgccgtacagccggtcggtgacaccgcgctcaccgtggtcgttctcctcgacgtccgagtcgagcatcagcagcggtacgcggcccacctgggccagccagatccgggcctggagccgccgcccgccgggcagggcgagggagacctgggccagggcgccgtcgtcctcgcgcagcggcaccaccggcagttcgtgcgggtcgaggacgggatagtgctcctgctgccagccgtcgcgggacagcgactggcggaagtagccgtgccggtacagcaggcccaccccgatcaggggcacgcccaggtcgctggccgccttcagatggtccccggcgaggatgccgaggccgccggagtactgcggcagcgcggccgtgacgccgaactccggtgagaagtaggcgatggcggcgggcagttcggccgcgcgggacggggcctcggcctgcgactggtaccagcggtcgccggtcacgtagtcggtgagatcgtcggcggccgcgcccagcctgcgcaggaagcggcggtcctccgccagctccgcgaggcgcgcgtgcgggacgctgccgagcagccgtacgggatcgccgtccgacgccgcccagcgctcggggtccacggactggaagagctcacgggtctccgcatgccacgaccagcgcagatttcgcgccagatcgctgagcgggtgaagggcgtcggggagtacgggacgtacggtgaacctacggatggccttcacgagttccaccttcacggaggacgtacggaggacgtacgaagggcgtacggaggacatgcccggttgagggccgcacctcctcgtgcggcccttgttcacccacgacggtagcggtgcgggcgcctcggcaactacggcgcatgaagcgcgccccctgcccgtcgctcccccttcggcagaaattcaccgcggccttcacaacacgtgcccgccacgggccatcacgtgcccgccgcgggccatcgggtgcccgccacgggccgccacgcgcgccccacgggcaagacgagcgccccctgggccattcgtgcgcccctctcacgatatggccgattccgcccgcctgcgcgaccttgtggcggttcacaccgcacgagaggctgcccagtggcgtgtcggcccgggccgtccggacgcgggcgaaaaccggtcggagcacgccgagtcgaggaggggaacccaagccatggcacggacgagcagcgctcgtctgcgctgggcaggaggcctgaccgcggtcaccaccgccgcggtgctttcggccgtcaccctgcccgcgcaggcagccccgcaggggcggatactcggcgccggcgatcccggttccgtcagcggaagttacctcgtgacactcaaggggggaacgagcgcgccctcggcggccggcaagagcgtcgccgggaagtacggggcgaggatcagccacatctacggtgccgccttgaacggctatgcggtgcaggccaatgagaagcaggcccggcggctcgcggcggacccccgcgtggcctcggtggcgcaggacaccgaggtcgctctcgaccactaccagaagaacccgccctcctggggcctggaccggatcgaccagaacgacctgccgctcgaccacggctacacctggccggagtcctcgggcgccggcgccggcgtgaccacgtacgtcatcgacaccggtatccgcgtcacccaccgggacttcggcggccgggcgagctacggctgggacttcgtcgacggcgaccggacggcgggcgacggcaacgggcacggcacgcatgtcgccggaacgatcgcgggcaccacgtacggggtcgccaaacaagccaaagtcgtcgcggtacgcgttctcgacaacgagggctccggcaccaccgcccgagtcatcgccggcatcgactgggtgaccaggcacgcgaagaagcccgccgtggccaatctgagcctgggcggcttcgccaacgcgcagctcgacgccgccgtacgcaactccatcgcctccggcgtcacctacgcggtcgcggccgggaacgacggactcgcggccggcctgtactccccggcccacgtgaaacaggccataactgtcggcgccggcgaccggaaggacgcccgtgcgagcttctccaactggggcccgcgcctggacctgttcgccccgggcgtggcgatcacctccgcctcgaacgcgagcgacaccgcgaaggccaccttctccggtacgtcgatggcgacgccgcacgtcaccggcgcggcagcgctcgaactggccgcgcatcccgaagccacacccgcccaggtcagcaaggcgctcgccgcccgggcggccacggggagaatctcgggcggcggccccggctcaccggacaaactgctccaggtgaacagcccttgacccggttttgaccgctcttaaccggacacgcgtaccctgaccggcctcgcccacaccgggtaaggccggtcttctgcgcacctcaccgcacacggctggtcttgtgtgtagacatacgcgtgagtagttaacaaagtgccggattgcccacccgaatagggtgggaaggctcctccggtacacccgcaggccccacctccccacaccctcatccgcccacccacgttgatgcggacaggagcggtcatgcccgcaacgcaccactcgccggcacccccggcgtccagtaccgactcaccccccatacgcaggggcgacgccggtccacccgccccggagacaccctccgcgggcaccacccccggcatcggacgcatccccgtcctcgacatccgtccgctcgtcgaccacgggcgccgcccggccaaagcggtcgtcggtgaggagttcgaggtctccgccacggtcttccgcgaaggccatgacgcggtcgccgccaatgtcgtcctcacggatccgcagggccgcagcggcccctggacccccatgcgcgaactcgcccccggcaccgaccgctggggcgccaccgtgtccgcgaccgccgccggccgctggacgtacaccatcgaggcctggggcgatccggtcaccacctggcgccgtcacgccgggatcaagatcccggccgggatcgacaccgaactcgtcctcgcggagggcgcgggcctgtacgagcgggcggccgccggagtaccgaagagcaagggcaggcgggaggtgatcctcgccgccgccgacgccctgcgcgacaccgggcgccccgccgcgtcccggctcgccgcggcgctcactgccgaggtggacaaggttctcgcgcggcatccgctgcgtgaactgctcacgtcgtcggagccgttgccgctgctggtggagcgggagcgggcgctgttcggttcctggtacgagttcttcccgcgttcggagagcggccgcgtggaccggccggtgcacggcacgttccgtacggcggccgagcggctgcccgccatcgcggagatgggcttcgacgtcgtctacctcccgccgatccaccccatcggcagcaccttccgcaagggccccaacaacaccctgtcggcggccgcccacgacgtgggggtgccctgggcgatcggctcgcccgagggcggtcacgacgcggtccacccggacctcgggacgatcgaggacttcgacgtgttcgtgcggcgggcccggggcctgggcctggagatcgccctcgacttcgcgcttcagtgctctcccgatcatccgtgggtggagaagcatccggagtggttccatcaccgtccggacgggacgatcgcgtacgcggagaatccgccgaagaagtaccaggacatctatccgatcgcgttcgaccgggacatgccggggctgatcgcggagacggtgcggatcctgcggttctggatgggccatggggtgcggatcttccgggtggacaatccgcatacgaagccggtggtgttctgggagcgggtgatcggggaggtcggccggacggatccggatgtgatcttcctggcggaggcgttcacgcggccggcgatgatgcgggcgctggcggcggtcggtttccagcagtcgtacacgtacttcacctggcgcaacagcaagcgggagctgacggagtacctgaccgagctgtcgggggaggcggcggccgttatgcggccgaacttcttcgtcaacaccccggacatcctgcatgagttcctccagcgtggcgggcggccggccttcgaggtgcgggcggtgctggcggcgacgctgtcgccgtcgtggggggtgtactccggctacgagctgtgcgagaacaccccggtgcgcggcgggagcgaggagtacctcgactcggagaagtaccagctccgcccgcgggactgggcggcggccgagcgcgagggacgcagcatcgcaccgctgatcacctcgctgaacgagatccggcggcgcagccccgcccttcgtcaactgcgcgacctgcacttccaccacaccgacaaggaagaggtgatcgcctactcgaagcgcagtggatcgaacacggttgtggtggtggcgaacctggatccgcaccacacccaggaggcgacggtctcgttggacatgccgcaactcggtctggactgggccgcgttcgtgccggtgcgcgacgagctcaccggggagagctaccactggggcagggccaactatgtgcgtctggagccggggcaccggcccgcgcacgttctcaccgtcctgcgaccgtcctcaccgcagatcggagggtcacccacacgatgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagcgacctgcacccgtggttccaggagtcccgcagcaaccccgacggcccctacggcgactactacgtgtgggccgacgacgacaagcagtaccaggacgcccggatcatcttcgtcgacaccgaggcctccaactggaccttcgacccggtccgcaagcagtactactggcaccgcttcttctcccaccagcccgacctcaactacgagaacccggcggtgcaggaggagatcgtctccgccctgcggttctggctcgacctcggcatcgacggcttccgcctcgacgcggtgccgtacctgtaccagcaggaaggcaccaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcggcatgggggacaacatctggctcggtgaccgggacgcggtgcgcactccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgccgtctagaacctcgggcggggcggataacaccgacccgcccggggcacccatcagtaaaaccccgaatccccaggactccgggtccctggggaaaggacgcgacgccatgtcggaagccgtcactcgtgccaccaggacaagtcccgggctccttgcgtccctcgatccactgctgcgggagtggctgccgcggcaacgctggttcgcgggcaaggggcggccggtcaccgggttctcactggtcgcggccaccgaactgctgccgcccaccgccaagttgggcctgctccacctcctcgtacgggcccatcagccggatgtccccacccacggcgcgatgacgcaccccggggactgctaccagctcctgataggcgtgcgcgaggcgctgccaccccggctggcgcccgcgctcatcggacatccggacgacggtccgctcgccgggcggaccgtgtacgaggctctccacgacccccgccccgccgaagtgctcctcgaagcgctgcgggcacgggcccgcatcggcgaactgcgcttcgaacgcgatacgcggcaggagatacccgacggactgatgccgcgcctgatgaccgcggaacagtcgaactcctcgatcgtctatggagatacgttcatcctgaagctgctgcgccggatcgtgccgggcgtcaaccccgatctggaactgccgttactgctcgcccgcgagggctgcccccgggtgcccgcgccgacggcctggctgctcgccgacctcgaaggccccgacgactcgtacgtcctcggcgtactccagccctttgtgaagggcgcggccgacggctgggaactggcgctgcgtgaactggccaagggcgaggacttcagcacccaggcgcgggcgctcgggcgcgcgacggccgaggtgcacaccgcgctggcccgcgcgacgcccccggtcaccctgggacacgcacaggtgcggctgctggtcgacggcatgacggagcgcctggaggcggccgcgcaggcggtgcccacgctgcggacgtacgcgcccggcctgcggtccgcgttcgagacgctgggcgagctggccgccgagggacgcacctggaacgcccagcgcatccacggcgacctgcatctgggccagtgtctgcggtcgccgtccggcacctggtcgctgatcgacttcgagggcgagccgtcgaagtcgctggccgagcgccggctgccacagcccgtcgcgcgggacgtggccggcatgctccgctccttcgactacgcggcccactcgcacgaaccccgggtgcccggctgggcggacacctgccgggccgcgtactgcaccggctacgccgagatctccgggctcgatccccgtaccgaccccgtgctgctgcgcgcctacgagacggacaaggcggtctacgaagtcgtctacgaggcccggcaccgccccgagtggctgccggtgccgatggcggcggtacaccggctgtccgccgacgccgcaccgtgaacctccgcgccaccctgctgaccttgccgaccctgccgaggaggcactcgccgtgatcccccgtcctccgtccgacgaccgcgcgaaccagaacggtgacggttcgaagaagaccggtgcgaagaagaccggtgcgaagaaggcggctgccgcgaagaagacggctgggaagaaggccacgccggcggcgaaggcgacggccgcgaagggggcggtgacgaagaagaccgggaaggggaaggcgaccgccaagaaggccgtggccgacaaggccgccgccaaagcgaccgttccccagcaggccgttcccaagcaggccgtgtccaagagggccgtgtccaagaaggccgtgcccaggaaagccgtggtcaaggcggccctcgacatccccgaagcgcccgtctcccccgccgtcgcccccgacgaccgcgaccggctcctgtccggcacgcaccacgccccgcactccgtgctcggcgcgcatcccgtgcccggcggggtcgccttccgcgtgctgcgcccgtacgcgctgtccgtcaccgtcgtcaccgacgacttgcgcaccgagctgcacgacgacggcgccggcttcttcaccggcctgctgccgctgcgcgccgtaccggactaccggctgcacgtggcctacgagggcacggtccacgagaccgaggacgcctaccgcttcctgcccgcgctcggcgagctggacctgcacctcatcaacgagggccggcacgaggagctgtggacggcgctcggcgccgaaccgatgacgcaccagggcgtgcccggcacccgcttcaccgtctgggcgccgaacgcgcgcggcgtccgactggccggcaccttcaacttctgggacgccaccgccttccccctgcgctcgctgggctcctccggcgtgtgggagctgttcgtgcccggcgtcggcgagggcgagctgtacaagttcgagatcacccgccccgacggctcgaagaccctgcgcgccgaccccgtggcccgccgcaccgaggccccgcccaggacctcgtcgatcgtgcacgcgtcgcactacgcgtgggcggacgaggcgtggatggccgcgcgcggcgagcgtcccgtgcacgagtcgccgttctccgtgtacgaggtccacctgccgtcctggcggccaggactgacgtaccgtcaactcgccgaacagctccccgcctacgtcgccgacctgggcttcacccacgtcgagttgctgcccgtcgcggagcaccccttcggcggctcctggggttaccaggtcaccggcttctacgcccccaccgcccgcctgggcacccccgacgacttcaaatacctcgtcgacgccctgcaccgggccggcgtcggcgtcctgatggactgggtgcccgcccatttcccccgcgacgactgggccctggccgaattcgacgggcggccgctctacgagcacgaggatccgctgcgggccgcgcaccccgactgggggacgttggagttcgactacggacgccgggaagtgcgcaatttcctcgtcgccaacgccgtgtactggtgcgaggaattccatatcgacgggctgcgcgtggacgccgtcgcctcgatgctctacctggactactcccgcgaggaagggcagtggagcccgaacgagttcggcggccgggagaacctggacgcggtcgccttcctccaggagatgaacgccaccgtctaccggcgggtgcccggcgtggtcacgatcgccgaggagtccaccgcctgggagggcgtcacccgcgccacacatgacaacggcctcggcttcggcctgaagtggaacatgggctggatgcacgactccctcggctatgtgcagcacgagcccgtgcaccgcaggttccaccaccacgagatgaccttctccatggtgtacgcctacagcgagaactacgtcctgcccatctcccacgacgaagtcgtgcacggcaaaggctcactggtgtcgaagatgccgggcgactggtggcagcagcgggcgaccgagcgggcctatctcggcttcatgtgggcccatccgggcaagcaactcctcttcatgggtcaggagttcgcccagggcgcggagtggtccgagacccacgggcccgactggtggctgctcgatccggcgtacggtgccgagcccgaccaccggggcatgcgggatctggtgcgggacctgaacaccgtctaccgtcacgaacccgctctgtgggagcgcgacacggacccgtccggcttcgcctgggtcaccggcgacgccgtcgaggacaacgtcttcgccttcctgcgccacgccgccgacggcaccccgctcctcgccgtcagcaacttctccccggtcgtccgccacgactaccgcctcggtgtccccgacgacatccccgcctggcacgagacgctcaacaccgacggcgcccgctacggcggcagcgacgtcaccaacccgcacccggtgaagcccgaaccgcagggccgccacggccgcccggcgagcatccggctgaccctgcccccgctctccacgctctggctgcgaccggcctaacccgcccttcccgtaccggtcatcagccggcgcagcgccgacagcaggcctctggagcggtggtcggcggtgggcgcggtgtccggtgcctcgccgtcgtgccggggcggcggcacggggtgggactccgacggcgtccccctcagctcgtagcggaccgggagcagccgcagacctcgtacgaccgggccggagcgccagggcaactggtcggccggaagggtgagttcggccttggtgaagtggtcgaagatccggcccaccgccgtggtcacgatcatgcccgccagctcgcgggccgcgccggggcactggtgctgtcccgctccccagcccagatgggcgcgggtgctcgcggtggcgtcaccgaggggggaggtgccgatcgtcagcaggtcctggtgggcggccgcggctgacggggagacgacgtcgcccgccctgatccagaaggcgccgaggcgcacgtccccggcggcgaagcggaagcacatgttggccaccggcgggttgaccagcgccacgcggtggaaggtctcgccgaggtgcccgtccgacacgctgcggcggacggtggcgttgccgcgcagcacctccagcagggtgttcatgaccatgttgccggtgatgtcgttgaggtagacggcgttcatcaacagctcgcggccgagctgctcgtcggtcatgcccgggtcggcgaggagcaggtacgaggtgaggtcgtcgccggggcgctgtctgcggtgggcggcgagccgggtcatgacagcggccgcgcggtcggtggcggggcccgcgtccgggccgccgtcgagcatccgccacaggtccatgaccagctcgtcgccgagtcccaccggacagccgaacagcttgccggtgaccatcagcagcagcggtctggtgtactgcgcgcccagatcggcgtacccggcggagcccgattcggcggccagcagggcgatgagttcgtccgcgtaccgggcgacggccgcccgcagttcccacccctgcgggctgtgcccgtcctggaaggggcgcagggccgagtggtgggtcagccgggccgcgtggtgctcgtcgccgtccaggaacatggtctgccgcacctcgtagcccgcgagcaggggccagtcgcgcggcagttgcccctgtgcgcgcgcccgccagtaccggatgtcgcgccgccactggctgtcgtcgcgcagcacctccaggacctcgtggtagtcgaggaccagccagacgggcacgcccatcaggccgaccggcgcgaccgggccgtacgtccgccgcagccgctcgtacacgccggccgggtcggcgtcgaactccgatgtcagcagaggttccacgcgcagtgactcgagcctggggctgccggccggggcggtcgcgtagggctgggcttccataccgctacgcataccgcaccggccgtgcacgagcggtgaccggagccttaactgttaccgcttggtaatacccggggcgggtgtgccgtcggccgggtgcggctccccgtccgccaacgccttcggcagctcgcccgtgtgcagcacacccagccgctgggtggcgcgggtcagcgcgacgtacaggtcgctggtgccgtagcgggccggctcgaccacgagcaccgagtcgaactccaggcccttggactggcgcggatcgaggaggacgaccgtgtgggtcagatcgggctcggcgcccgccgtgacgccgtcgaggcgtgccgccagcttccggtgcagctcgcgcggtgcgatcaccgcgagccgcccctccgccggggtcagctcggcgaccgcctcggcgacggcactgggcaggtcgtcggtggcgcgcacccagggccgtacgcccgtcgaccgcacggaactcggcggctcgaagccgggccgctcggcccggaccacggccgccgccatgtccatgatctcggacggcgtgcggtagttgacggcgaggcgcgtgtggtcgaagcggtcctggacgtagggggcgaggatctcctcccacgagccgacgcccgccgcctcggcggtctgcgccgggtcgccgaccagggtcatcgagcgggtcgggctgcgccgcatcagcagccgccacgccatcggcgacagttcctgcgcctcgtcgacgatgatgtggccgaacgcccaggtgcggtcggccgccgcgcgctcggcggcgctgcggtggtcctcctcctcgtgccgctcggcgaaccgctcggcgtcgatgatgtggtgcgcggacagaacctcggagtcctcctcgtccttgtcctcgaactcatatgtacgcgaggcgtacgacacgtccagcacgccctgcgcgtacgcgacctgggtgttccgttcgcggtcggcgagggcgcgggccagccggtcgtcctcgccgagcagttcggccgcctcgtcgaggagcggtacgtccgccgtggtccacgcccgggtgaccggacggcggatcgcggccgcgtcctcggcggacacatacccctcgggctcggcgaggaagtccgcgaccagccgctgcggagtcagcctcggccacaaccggtcgatggccgaccagacttcgcggttctcggccagctcgtcccggatctgggtgatgtcggcggcgtccagcaggttggagccgtcgaaggggtccgtgccgatccgctcggccaccatgtcggtgagcgtgttgaggatgtggccctcgaagtactcgcgggccacgttgtgcggcagcttcgcctcgcgcgtgcggtcgcgggcgacgcgcaccagaccgtcgtcgagcatcagcacgtcccggtcgtgctcgatggtgatcaccgggtcgggcagcgcctgccggtcgcgtacgacctcggcgagcacctccgccatctcggcgcggcccttgaccgcggacgcccgcggattgtcggccgccgtcgccttcacaccggggaacagctcgccgaccgtcgccaggagcacgcccgtctcgcctagcgagggcagcacctcgccgatgtagccgaggaaggcggggttggggccgacgatgaggacggctcgcttggcgagcagctcccggtactcgtagaggagaaaggcggcccggtgcagggcgacggccgtcttgccggtgcccgggccgccctccacgaccagcaccccgcggtgcggcgcacggatgatccggtcctgctcggcctggatggtctgcacgatgtcgctcatccggccggtgcgggccgagttgagcgcggcgagcagcacggcgtcgcccgtcgggtcctcgtggccggtcctcgtggcgtcgccgaggtcgaggagctcgtcgtgcaggtcggtgacccggcgcccgtcggtggtgaggtgccggcggcggcgcaggcccatcggggtgtgcccggtggcgaggtagaaggggcgggcgacctgggcccgccagtcgatcaggatcggggtgtgctcggtgtcgtcggcgcggatgccgatgcggccgatgtggtggctgacccccgaggtgaggtcgatccggccgaagcagagcgattcgtcgaccgcgttcagcgcggcgagcagccccgagcgctcggcgacgaggacgtcccgttccagcctggcctgcatgggcgtgttgccctgcgcgagcgcgtccgtgacggagacctcggtgacaccgcgcagggcgtccacgcgcgcgtacagtccgtcgatgaattcctgctcaagccgcaattcatcgtcggtaaataccgcgccggccgtgctgccttctgtgttagagccgctgtttgacaattccgctcccgcccggatatactgtgcccagtgaacttctttgcgacctcattccattgaagtcgcgaactcttgaatatacgcaaagaaatcccccgagcgcaattgcgctcgggggatttcttgtggtcgggcgggttacagcacgtcggccagctcctccagcagccgccgcttgggccgggcccccaccatcgacttcacgggctcaccgccccggaacaccatgaaggtgggcatcgacagcaccttgtacgcgttcgtcgtctccgggttcgtgtccacgtccagctggaccaccttgagccggtcgccctcctcgaaggcgagggagctgagaaccggccccatctgccggcacggcgggcaccagtccgccgtgaactccaccagcacgggcaggtccgcgccgatcacctccgcctcgaagtccgcatccgtcacttcggtcacgcccgccgccttgatcaccgcgtctgccctcccagttcgcacacgggctccggaccgcccggaacccccgcctcggccgccagctcgtcgcgggccagctcggcccgcgccagctggtcgccgacctgcgcccgcacggcctgcaactcgccgatcagcgcgtcgagttcgccgagcttgcgccggtacaccgcgagcgacgccgggcacgagtcgccctccgggtggccggcccgcagacactccacgaagggccgcgtctcctccaggtcgaacccgaagtcctggagcgtcctgatctgccgcagcagcttcaggtcgtcctcgtcgtacgtgcggtagccgttgctgccccgccgcgcgggcagcagtccccgcgactcgtagtagcgcagggtgcgcgtggtggtcccggcccgcgtcgccagctcgccgattcgcatgcccccgaacgtagtccttgacgccgacgtcaaggcaacaccgtcagtgcggcggcagcagcggcttccgctccaccggggaggagagcacgatcgacgtggtcgtgcggcccagcgccgaggtctgttcgaggatctcctccaggtggagggtgtccgctacggcgaccttgaggatccagcagtcctcgccgacgacgtggtgcacctcggtgatctcggggcgggccagcagttccagagtccgggggtgcctgaggctgtacccggcgtgcgggttcacgcggatgaaggcccggacgccgtagccgagccgggccggcgagacatgggcgccgtacccggtgatcgcgcccgccgcctcgagccgccgcacccgctccgcgacggccgccgggctcagccgcaccctccgccccagctcgctgagcctgatccggccgtcgctctgaaggagctccaggatctgccggtcgagggcgtcgaaggccaccgacgtttcgtgggcggcggctcgcggatgccgtggttctttcggtgccgaggccgcatctcccatggttcccccttcagacctgtcacgtggaacgggagaattatggcctgttccgtcggcctgattcggcggctcgtttcgccggctcgtttcgtcggcctgattcctttggaggggtgctgtgcgtgaagtgtgcgtcattggcgggaaccggtatttcgggaagcggctcatcgcccggctgatggccgccggagaccgcgtcaccgtcatcaaccgcggttcgtcggcaccgccgcccggcaccattcatctcgtcgccgaccgcaatgaggagagatccctggaaagcgcgctgggctcgcgcaccttcgacgtcgtcgtcgaccaggtctgctacaccccgcgccaggcggcgatcgcccgccgcgtcttcgccggccgcacccggaggtatctgatgacgtcgacggtcgaggtgtacgagtacgaggactcccccgcgccggtgcgcgaggacgccctcgacccgcgtacggtcgccgtcgacctcgacctcccctgggacgacccgcagttcctcgacagcaactacggcgagggcaagcgtcaggccgaggcggtcctcgcggcggaccccgccttcccgtacgccgccgtacgcgtcgcccatgtgctgggcggcgacgacgacttcacgggccgtctcgcccactacgccgagcggatgcgcaccggcgagcccatcgccgtccccgccgtgaaccacccggcgacctacatccatgtggcggagatcgccgacttcctcgcctgggcggcgggcgccgacttcggcgggccggtcaacgcggcgtcccacggaccgctcaccaccgaggaactgtgcgcggcggtggccgcgcacataccgggcgggacggccgtgttccgggaggtggaggtcggcgaggtctcccccttctccttcgcccgctcctacgcgatggacaactcccgggccgagcgtctcggcttcaccttcggcgacgcgagtgaatggctgcaccgggccgtcgccgagacgctcggcagatagtccgggagaagggtcgggagacagaccgggagacagaccggaagacagacgggcagagccaccgtcaccaccaccgccaccgccaccgccgccacgccaccgccaccggcgggcgtttccggggcttccgctcacggtaggaagcggttgtgcgcagaccgaccgggcagacgggcgaggcggacgaggcggacgaggcggacgaggcggacgacgaggggagacgcatggcacagcgcgacaccggtggccggttgggggcggagttcttcacccccggggactcgtccttcaccgcgttcctggcagcccaccgtccggcattactgagcacccgcggcctcctcccggacggcgtccgggccgcgcccgaccgtgtcccgcacggcaccacggtcctggccctcgcctaccgcgacggcgtgctgatcgccggcgaccgcagggccaccatggggaacctgatcgcacagcgggacctggagaaggtgcaccccgcggacgactacacggcggtcgcgttcgccggcaccgtgggactcgcgctggacatggtgaagctctaccaggtcgagctggcgcacttcgagaaggtcgagggcgtcccgatgaccctcagggcgaaggcgacccggctggccggcatgatccggcagaacctcggccaggccatgcagggcctcgccgtggtcccgctgctcgtcggatacgacctcgcggcccgcgccggcgaacacggccgcatcttcagcttcgacgtcaccggaggcccgtacgagaagacggacttccacgccgagggctccggctccccgtacgcccggggcgcgttgaagaagctgttccatccgggcatgtcccggcgtgaggcggccctggccgcgctccaggcgctctacgacgcggcggacgacgactcggccaccggcggtccggacatcagccgccggatcttccccgtggtgtccgtcatcacggaggacggcttcgagcggctcccggagtccgagacggaggacctgagccgggagatggtcgaacagcgccacacccgcccggacgggcccaccgccgccatgtgagcggctgtgggggcgctccctggacgtacgaaccgggggcgctccctggacgtaggaatgtgccgtgccgtgccggtggatccggcacggcacggcacggtggcgcatggggtgaagaggcggcgggcggggccggggtcagcgagcctcgctgtccaccagctcttcctcctcctgcttccgcccctgcccttgctcctgctcctgctcctgctcctgctcctgctcctgctcaacctcccgcacggcggcttccttgcgcggcagcagcactcccaccagtaccgtccccacgcccaggaccaccgcgccgaccaggctggtgtgggcgaccgagtccgcgaacgcggagccgaccgcgtccgccatctgccgggcgccgtcggcgagttggcccgactgcaccttcaaccgcgcggcctgttccgtgctccccgcctgcgccgcctgctcgccgaggtgtcgcgccttgtcgccgatgccccgcgccaccgcgtaaccggcgccgaccgagtcctgcgcctggctcagcgcgctcgcgggcagcttgctgccggtggtcgcgtccgagaggtgcgaggagtacgaaccggccaggacggacccgaggatggcgatgccgagcgagccgcccagctccagcgaggtgtcgttgacggcgccgcccacccccagctcggcctccgggaacgcccccatgatcgcgtccgtgcagggcgacagcgcgagcccgatcgcgaggcccaagatgacgagggggaggacgaagtcgccgtacgacgatgccgcgtcgacccgggtgagcagcgcgagcgcggccgtgccgcccaccatgcccgccgtcaccgtgatcttcatgccgacgcgcggggtgaggtagccggtcagcgccgagccgacgaacacggccccggcgagcggcagcatgcgcaccccggtgtccagggcgtcgtatccgaggacgaactggaggtgctgggtgaggtagtagaaggcgccgaacaccgccaggaagaagagggcgacggcgaggttggagcccgcgaagcggcggtgcgcgaaacggcgtacgtccaggacggggcgcgggtgacgcagctcccagccgatgaagaggacgaagccgacgcccgcggcgaccgcggccgtgaccgccttgacgccccagccgaagtgcggcccctcgatgatcatgtagaccagcgagccgatccagacgacggacagcagtccgccgacgtagtcgatgcggtggtggtgggcggccctggacggcggcacgaggacgaacgtaccgatgacggccacgaaggcgatgggcacgttgatgaggaacgtggacgaccagccgtggttctggagcagcgcgcccgcgaccagcgggcccgccgcgatcgcgaggcccgccgtggcggtccacagggtgatcgccttcgcccgttcggcgcgcgggaaggtcgcggcgagcagggagagcgtggcgggcatgatcagcgcggcgccgacgcccatgacggcccgggccgcgatgaccccggtggcgctgtcgacgagcgagcccgcgaccgctccgccgccgaagacgacgagcccgagcacgagcgcgccccggcggctgtacttgtcgccgatcgcgccgagcagcagcatcagcgcggcgtacgggacggtgtagccgtcgatgacccactggaggtcggcgctggacaagccgaggtcctgggtcatgtcgggggccgcgaccgtgagggcggtgttcgccatcacgatgatcagcagactcaggcagagcacgagcagtgcccaccagcgccgggcgtagggccggtccatcctctcgaccggttcgttcatgacgagacgcatgggtacggttcgcccttcctcaatcgacttgcacagtggagtgcaaatgcacaaccatgtgcaatgtacgtcgttgcacaatgctgtgcaaatggaggaggtgaagcccttgcggaggaacggcgaaccccggccgcgaggcaggcagaatggctgacatgaccacgggtaacaccagccgcgccgacgccaaccgccgccggatcctcgatgtcgcgctcgccgagctgctgcgcgaccccgatgcgtccatggaccagatcgcccgggtcgcgggggtcgtacggcgcaccgtgtacgggcacttcccgagccgtgaggcgttgatcagcaccctggtcgacggcgccgtcgaagcggtcgcggccgcgcacgcggcgggccgggagagcgtggcggacccggccgagtcgctggcccgctcgacgctcgcggtgtgggagatcgccgaccggtaccggatcctggtcgcgctcgcccagcgcagcgtcaccgtgcagggcatccgggaccgcctcacgccggtccgtcaggcgtgcgtggagttgctccggcgcggcctggagcagggggtgttcgagtcgccgctgccggctgcggccctggcgtacgtgcacgagcagatgctgttcgcgctcatggaggcggtgaacgacggcctgctggcagccgaagaggcgggccgctccgccgcggtcacgatgctgaccgcggcgggcgtacccgcctcccgcgccaccggactggtggcgaagctgagcgactgaccactgctgccgggcagagtggaaccgagcggccgggcctacgggggagtgacccagccgctcggagtggtgggggaactacgccttggcgagttccttctcgccgccctgctcgggcacctccgcgcggacgtcgtcctcggcgtcgtccagcagcgtcttctcgtcgaagggcagctcaccggcgagcacacggttcacccgctccttgtcgacctcgccggtccaggtaccgatgagcagcgtcgccacggcgttgcccgcgaagttggtgacggcgcgggcctcgctcatgaagcggtcgatgccgatgatcaggccgacaccgtcgaccagcgcgggcttgtgcgactggagaccgctggccaggacggcgatgccggaaccggagacaccggcggcacccttcgaggcgatcatcatgaagagcagcagaccgatctgctggccgatgctcatcggctggtccatcgcgtcggcgatgaacagcgaggccatggtcaggtagatcatcgtgccgtcgaggttgaaggagtagccggtcggcaccgtgatgccgacgaccgggcggctgacgcccaggtgctccatcttcgcgatgagccgcggcagcgcggactcggacgacgaggtggagacgatcagcaggaactcccggccgaggtacttcagcagctggaagaggctgaccttcgccaccagcttcgtcagcgtgccgagcaccaccacgatgaacaggaaacaggtgatgtagaagccgaacatgatcgtggccagcgccttgagcgcgtccatgccggtctcaccgatgacggccgccatggcgccgaaggcacccacgggcgcggcccacatgatcatgccgaggatacggaagaccagcttctggatgtgctcgaccccgcgcagcaccggctcaccggtacgccccatggcctggagcgcgaagcccacgagcagcgccacgagcagcgtctggagcacctggccctcggtgaaggccgagacgaaggtggtcgggatgatcccgagcaggaagtccacgggtccttccgcggcggcctccgcctgggtgtgccccacacccttcacggcctcggtcaggtgcatcccgctgcccgggtggacgatgttgccgacgaccaggccgatggccagcgccacgaacgacatcgcgatgaagtagccgagcgcgagcccgccgaccttgccgaccttggcggccttccgcaccgagccgacgccgagcacgatcgtgcagaagatgatcggcgagatcatcatcttgatcagcgcgacgaagccggtgccgatcggcttgagctccttggcgaagtccggcgcggcgaacccgacggcgatgccgagagccaccgcgacgatcaccgcgatgtagagatagtgggtgcggtcccgcttggcggcgggtgcggcaggtgccgtttgggctgtgctcacggctgccctccttgacgacgtcgtcggcatcatccggcgtgcggctcacgtccggggggagatcggtgtccggaaaagtcactcccggaccgatggcccggaaacgcactccggggttgcggcgactatgccccgccgctgtgagggcggtcaccctttcgtgcatttagttcatgcttatacgtaggggcagactgatcccatgcgcttcccccacgtgccccgaccccgcagcctggcgggtcagctcttcgccatgcaggccgtgctgatagcggtgctcgtggccggatacgcgctcttcacctacgtcagcgaccgcagccaggccgaggaggcggcgaggcggcagaccatggccgtcgcccggtcggtcgcggacgccccgtccgtgcgcgcggcgatccgcacctccgacccgtcggccgcccttcagccgtacgcgctccaggtacagcggcacaccggcgtcgacttcgtcacgatcatgaatccgcggggcatccgctggacccaccccaaccccgacctgatcggcgaacgcttcctcggtcacacgacccgagccctgaagggcgagtccttcacggagacgtacacgggcacgctcggcccgtccgtccgcgccgtcaccccgatccgtgacgggacgcggatcatcggcctggtcagcgcgggcatcaaggtggaggcgatcacgaagcgggtccaggaccaggtgacggccctgatcggcgtcgccgcgggcgccctcaccctcggcggcatcggcacctacgtgatcaacgcccggctgcgccgctccacgcacggcatgaacgcggccgagctgagccgtatgcacgactaccaccaggccgcgctgcacgccgtacgcgagggtctgctgatgctggacggccagttccgggtggcactgatcaacgacgggggccgggagctgctgggggtgacgggggacgtgatcggccgctcggtggcggagctgggcctgcccgcggcgctgacgggcgcgctgctgtcggcggaaccgcgggtggacgaggtccatctgacggccgcgcgcgtcctggtcgtgaacacctcgccggtctcgggcggcgagcgccgcggcaccgtcgtcaccctgcgcgatgtgaccgaacttcagtcgctgatgggcgagttggactccgagcgcggcttcaccacggcgctgcgctcacaggcgcacgaggccgccaaccgtctgcacaccgtcgtctcgctgatcgagctggggcgcgcggaggaggccgtcgacttcgccacggcggaactggagctggcccaggccctgacggaccatgtggtctccgcggtcagcgagccggtcctcgccgccctgctgctgggcaaggcggcacaggcgaacgagcggggcgtggagctggtggtgtcggaggagagcgccctcgacgacggtctgctgccgccctcgctcccggcccgggacctggtgacgatcctcggcaacctgatcgacaacgcggtggacgcggcccagggctcgatgcgggcgcgggtgacggtgacggtgttcaccgacgcgtcggggctggtgctgcgggtggccgacacgggcgcgggagtggatccggcgtacgcggaggcggtgttccagcggggctggtcgacgaagccggcgaccgcgtccggcggccgggggctggggctcgccctcgtccggcaggccgtcgcccgccacgaggggaagctgacggtcgcggaggcggacggcggcggggcggagttcgaggtgcggctgccgttgcctacggtgggtccggccggagccgccggcggatccgagcccacccgccgacacggtggtgcgtccgagcccgccctacccgccttgcctggaggcgacgacgtatgaccgagcccattcgcgtactggtcgtggaggacgacccggtggccgccgacgcgcacgtcatgtacgtcggccgcgtccccggtttcacggcggtcggcaaggcgcacaccggtgcggaggcgcggcgcgcgctggaccgtacgccggtggacctgctgctcctggatctgcacctgccggacgtgcacggcctgcaactggcccgctccctgcgggccgccggctatcacgcggacgtgatcgcggtgacctcggcgcgggacctggcggtggtgcgggagggtgtgtcgctgggggtggtgcagtacgtgctgaagccgttcaccttcgcgacgctgcgggaccggctgatcagatacgccgagttccatgcggcggcgggcgaggcgagcggccaggaggaggtggaccgggccctggcgaccctgcgggcaccgggcccggcggccctgccgaagggcctgagcgcaccgaccctggaacgggtgacgcgggctctgcgggactcggccgaggggctgacggccgcgggggtggccgaggcggtgggcatctcccggatcacggcacggcggtatctggagcacctggtcgaatccgggcgggccgggcggagtccgcagtacgggcaggtggggcggccggagttgcagtaccggtgggtgaagggctgaccgcacggacgtccgccgccgggaagcacgacgacgcggccgctcacctttccgacggggaggcgcttatgtgaggggcacctcgtcgagcgcgtacgtcccggtgggggcgacgcgcgccgaccccgcggggtacgcggcccagccgggatcaggcagtaccttccacggcccgttcatcgcccatcgggacgaccgggggcggtagagccgaagcccgtggagcagtccgggccttcacccgggccgacgccttcctcaaagccgctcaagtccgggccgctgcacatgcattgacctgactagaccattcctcttaccttcaccgggcagccgtcttggccacaacgacgtaggccagtaggaggtcgtgcccgtgcgccccaccgccgcccgcccccgcaccactgccccgcttcttctcgccgccctgctcaccgtctccgccggcggtgccctcaccgcctgcggcagcggttccggaagtgatccggacacggtgaaggtctccttcaaacagtccatggacaactcgatcaaggtcacggacacctacctggccggcatcaagaagcagttcgagaaggagaaccccggcaagaaggtcgaactcgtccccatcaaggccccggactccgagtactacacgaaggtccagcagatgatgcggtccccgaagaccgcccccgacctggtctacgaggacaccttcctcatcaactcggacatcaccagcggctacttgaagcccctcgacccctacctcgccaagtggcgggactgggaccagttcctcgacacggccaaggcggccgccaagggcgaggacgggaagacgtacggcgtccccgacggcaccgacacccggggcctctggttcgacaagggcgtcttcgagaaggccggtctgcccgccgactggcagccgaagacctgggacgaggtcctctccgcggctcgtacgatcaagaagaaggtccccggcgtcaccccgctgaacgtgtacacgggcaagccggcgggcgaggccgccacgatgcagggcttcgagatgctgttgtacgggacgggcgacggcacggcggaccccctgtacgacacggccaccaagaaatggatcaccgcgggccggggcttcaaggacgccctccgtttcgtcgagacggtctaccaggagaagctcggccccgatgtctccgacgccctcgacccgaacttctcgaccgcggtccgcggtgaactgctgcccaagggcaagctcggcatcgacctggacggctcctggctcccgcaggactggctgaagggcagcggccacgagtggcccgagtggtcgagcaggctcggcctcgcggccatgccgacgcaggacggccgggcacccggcaaggtgagcatgtccggcggctggacgtggtcgatcccggcgaaggccggcaaccccgacctggcgttcaagttcatcgagacgatgcagacggcggcgaacgcacggaagtggtacatcgccaactccggcatcgcggtgcgcaaggacgtcgccgaggaccccgcttacacgaaggcccagcccggcatcaagttcttcacggacctggtcgccagcacgcactaccgccccgcgtacccggcgtaccccaaggtctcgaccgccatccaggaagccatggagggcgtgaccacgggtgacatgtcggtcgacaaggcggcgagcggatacgacgaagcgctgaagacggccacgaacaaccaagtgatcgagaagtgagcgcggacacccgagccgccccgggccgccccctgaccgggaaggccgccgcccctcgccggaaaggcgcccgccgctccctggtccgcgccctcccggccgcccccgccgtcgtcctcctggtcctcttcctcgcgggcccgatcggctactgcgcgtacatcgccttcaccgatctccagctcacgggccaggcccacgcgtcgttcgtcggtttcgacaacttccgggcggcgttcaaggacgaggcgttcctgaacgcggtctggctgacactcgtcttcacggtgctgtcgtcgctggtcggccagaacacgctgggcctggcgctcgcgtcgctgatgcaacgggcgtcgaagccgatgcgtacgctcgtcggcgggatcgtcatcacggcgtgggtgctgccggaggtggtggcggggttcctgctgtacgcgttcttccggcgggagggcaccctgaacgccatcctcgacgggcttcacctcccctcccagaactggctgttcacgctgccgatcctggcggtctccttcgcgaacgtatggcggggaacggccttctcgatgctggtctactcggcggcgctgaacgagatccccaaggagatcacggaggcggcggaagtagacggggcgggcggctggcgccgcatgtggcacatcacgctgccgatgatccgccggtcgatcggcaccaacctgatgctgaacaccctccagaccctgtccgtcttcggcctgatctgggtgatgacgagaggcggccctggaaacagaagccagacgctccccctgttcatgtacgaacaggccttccagaagagcatgatcggctacgggaccgcggtggcgctcctgctgctggtggtcggctcgctgttctcgctcgtctatatgcggctgctgcggacggaggtctgagatgccgcgcactcccgcctcccgccgcacggcccaccggctcgcggcggacgccggcctgctcgtcgtggcggcggccttcgcgctccccctggcctgggtggtgctgtcctcgctggacgcgcacgccggactcgaggtgaaggtgccggacggcctgacactggacaacttcgacgcggtcctcaagccggacatcaccttcacgccactgctcaacagcctgatcctgtgcggcggggcgacgctcctgacggtggcgtgcgcggcgctcgcggcctacccgctgtcgcggttccggtcgcggctcaacaggccgttcctgctgacgatcctgttcgcgacgagtctgccgatcacggcggtgatggttccggtgtacgcgctgttcgtacaggtgaatctgatcgacaccctccaggggacgatcttcttcttcgcggcctctcaactccccttcgccatctggctgatgaagaacttcatggacggagtgccgaaggaactggaggaggcggcgtggacggacggagcgtcgtcgttccagtcgctgatccgggtcgtgctgcccctgatggggccgggcgtggcggtggtgacggtcttcgcgttcgtgatgatgtggggcaacttcttcgtgccgttcatgctgctgctcacgccggaccagatgccggcgtcggtgagcatcaacgacttcttcgggaatcgggggacggtggtgtacgggcagctggcggcgttctccgtcatctactcgacgccggtgatcctgctgtacgtgctggtcgcacggcggttgggcgggggattcgcgctgggcggggcggtcaaggggtgacgggacgggagtgacggggcgctcgggtgactcggcggacacgagcccggatgccggtgcggtcgtacggctcacacgggttgccggggccggggcgggctgcgcagacgtccggatcgcgccggacgttctccctccttgacaggtccgatcgccgcgttgatcatgacgtactcgccctcgatgtcgacccgcaccggcgacgcccgcggcaccccgccggcgcccggcggcagaggccgggggcgcggagccgctcgcgaatatgcccctctaccttgccgttcccccgcccacgccccctccaggcgtccactccggccacccgcggaaaccgttccgccccgcctcacacgggcgacaagtcggcccccggccagccggccccggcggccgaaaccgtatgttcctacaatcagtgattgtggccgaacagaccgtagtcaccgcagtccggcgcccatagcttgtgcgcgtgcacccaccgcaggcccaccagcccaccccgcccttcaacgccctcgccgcccgcagactgcgctcggctctcggcatggggcccgagcatgtcgcgtacggcatgcgtgcgtcgtacgggcttccctacgtcactcccgatctcgtcgtcgcctgggagcgcgggatcaccgcgccgagttcccccgaactcaccgcgctcgcgggggtgctgtggtgctcgccgggcgaactcatcggcgcgccgcggacgttgcgcgagcaccgggtcgcgcacggtctcgccgccgaggacgtcgcgcgggccgtcgggctcgaactcctcgtgtatcagcggatggaggagaccgacgagtggcgcggcaacgagcggcagtcgtccgcactcgccgatctgctcgaactctcgctgcccgacttcatcacggtgaccggacgcgacgcgaagctggcggagctgctgcgcagcgcggtcacgacgcgctggcaggcgtatgtgcggccggtcggcaagatggtgcccctggaccggcgcctgctggaggacgcgctccaggagctgcaccacgcctatcaggggcagatggtcgccaccctcagctggggcggcggcggcccggccgccgacgaggccggcgacgcgggccgcgacttcctcgaccggatcgtggagaacttctggtcgacggtccagcggagcacgtattgaggtgacctacggaggtcggcgcacctaccggggcacagggatctagaagaccgactccgcctcgtccatccggtccttcggcaccgtcttcagctccgtgaccgcctccgccagcggcaccatctggacgtccgtgccgcgcagcgccgtcatcctgccgaagtccccgcggtgcgcggcctcgaccgcgtgccagccgaagcgggtcgcgagcacccggtcgtacgcggtcggcgtgccgccgcgctggatgtggccgagaatgaccggcttggcctccttgccgaggcggtgctccagctcggccgcgagggccgtgccgatgccctggaagcgctcgtggccgaactggtcgatcgcgccgtggctgtagtccatgctgcccacgacggggtgcgcgccctcggcgacgcagaggacggcgaacttcttccctcgggcgaagcgctcctcgaccatcttcaccaggtgggcggggtcgaaggggcgctccggcaggcagatgccgtgggcgccggcggccatgccggactccagggcgatccagcccgcgtggcggcccatgacctcgacgaccatcacgcgctggtgggactcggcggtcgtcttgaggcggtccatcgcctccgtggcgacgcccacggccgtgtcgaagccgaaggtgcggtccgtggcggagatgtcgttgtcgatcgtcttcgggacgccgacgaccggcaggcccgcgtccgagagcatgcgggcggcggtcagggtgccttcgccgccgatggggatcagcgcgtcgatgccgaactcgcgggccatgtcctgcgcgttctcgcaggcctcacgcaggcggtcgcgctggagccgggaggagccgaggatggtgccgccgcgggcgaggatgccgctgaccgcgttgaggtcgagggcgcggtagcggccgtcgagcaggcccgcgtagccgtcctcgaagccgatgacctcgtcgccgtacatcgtgaccgctcggtgcacgaccgaccggatcactgcgttcaggcctgggcagtcgccgcctgcggtgagtactccgatacgcatcgtgctgtgtctcctgctcgctgttgacaccggtgagccagtccgattgtttcacgcctcacaggtggtcgccgctcccacctgttgacgggcgccttatccacccgcagaggtactgtcaagggggttccacccggcacggcgggtgattttcgcggcctcgagcccctcacacgaaacggaacggagagcacgcgtgacgcgcagcgtgtacgtgaccggaatcgaccgcggcgacggccgccaggtcgtcgagctgggggtcatggagcttctgacccgccaggtcgaccgggtgggggtgttccgcccgcttgtgcacgacggtcccgaccgcctcttcgagctgctgcgcgcccgctaccggctcgcccaggacccggcgaccgtgtacggcatggactatcacgaggcgtccgcgctccaggccgagcaggggaccgacgagctgatgtccacgctggtcgaccggtttcatctggtcgcgcgcgactacgacgtcgtcctcgtcctcggcacggacttcgccgacacccagttccccgacgagctggccctcaacgcccgcctcgcgaacgagttcggcgcggccgtgatccccgtggtcggcgggcgcgggcagaccgccgagtcggtgcgcgccgagacccgtaacgcctaccgcgcgtacgaggggctcggctgcgacgtcctcgccatggtggtgaaccgggtggcccgagaggaccgcgaggaactggccgcacggctcgattcccttctcgccgtgccctgttacgtactcccggacgagccggcgctctccgcgccgacggtcgcgcagatcacgcacgccctgggcggcaaggtgctcctcggcgacgactcggggctcgcccgggacgccctcgacttcgtgttcggcggtgcgatgctgccgaacttcctcaacgcgctgaccccggggtgtctggtggtcaccccgggcgaccgcgccgacctggtggtgggcgcgctcgccgcgcacagcgcgggcaccccgccgatagccggtgtgctgctcaccctcgacgagcggcccagcgacgaggtcctcaccctggccgcccggctcgcgcccggcaccccggtggtctcggtggccggcaccagcttccccaccgcggccgaactgttctccctggaggggaagctgaacgcggcgacgccccgcaaggcggagaccgcactcggcctgttcgagcggtacgtcgacaccggcgacctgctgaagcgggtgtccgccccgagcagtgaccggctcacgccgatgatgttcgagcacaagctcctggagcaggcccgctccgacaagcggcgcgtcgtgctgcccgagggcaccgagacgcgcgtcctgcacgccgccgaggtgctgctgcgccggggcgtgtgcgatctgacgctgctcggcccggtcgaccagatccgcaagaaggccgccgacctgggcatcgatctgggcggctcccagctgatcgacccggtgacctcacagctgcgggactccttcgccgagaagtacgcccagctccgggcccacaagggggtctcggtggagctggcctacgacgtcgtcgccgacgtcaactacttcgggacgctgatggtgcaggaggggctcgccgacggcatggtgtcgggctccgtgcactccacggccgccaccatccggcccgcgttcgagatcatcaagaccaagccggacacgaagatcgtgtcgtccgtcttcttcatgtgcctcgccgacaaggtgctggtgtacggcgactgcgcggtcaaccccgacccgaacgccgagcagctgtgcgacatcgccgtccagtcggccgccaccgcccggcagttcggggtggagccgcggatcgcgatgctgtcgtactcgacgggtacgtccggttcgggcgccgacgtcgacaaggtgcgcgaggcgacggaactggtccggctgcgccgcgacgacctgaagatcgagggaccgatccagtacgacgccgccgtcgagccgtccgtcgcggcgaccaagctgccgggctcggacgtcgccgggcaggcgtccgtgctgatcttcccggacctcaacaccggcaacaacacctacaaggccgtgcagcgctcggccggcgcgatcgccgtcggcccggtcatgcagggtctgcgcaagcccgtcaacgacctgtcccgcggcgccctcgtgcaggacatcgtgaacaccgtcgccatcaccgcgatccaggcccagtccccccacgagaaggcgaccgcccagtgagcccgacccgcgtcctcgtcctcaactccggctcctcgtcggtgaagtaccagctgctcgacatgcgggacagcagccggctggccgtgggtctggtcgagcgcatcggtgaggggacctcccggctgaagcacacgccgctcaccacgggtgtctcccgggagctgaccagcccggtcgccgaccacgcggccgccctcaagaccgtcgccgaggagctggcgaaggacgggctcggcctggactcccccgagctggcggcgatcggccaccgcgtggtgcacggcggcaggtccttcaccgagccgaccgtcatcgacgacgacgtcctcgccgagatcgagcggctgatccccgtggcgccgctgcacaacccggccaacctcaccggcatccgcaccgccatggcgctgcgcccggacctcccccaggtcgccgtcttcgacaccgccttccacacgacgatgccggagtcggcggcgcgctacgcgatcgacgtgaagacggccgacgagcaccgcgtccggcgctacggcttccacggcacctcgcacgcgtatgtgtcccgggcgaccgcgaagctcctgggcagggcgccgaaggacgtgaacctgatcgtgctgcacctgggcaacggcgcctccgcgtcggccgtgcgcggtgggcgctgcgtggacacctccatggggctgacccccttggaggggctggtgatgggtacgcgctccggtgacatggatccggccgtcatcttccatttgatgcgggtcggcggaatgtccacggacgaggtcgacactctgctcaacacgaagagcggtctgatcggcctgtgcggcgacaacgacatgcgggagatccgccgccgtgtcgacgagggcgacgagcaggcggcgctcgccttcgacatctacattcaccgactgaagaagtacataggcgcctactacgcggtcctcggccgggtggacgcggtcgcgttcacggccggggtcggcgagaacgcggccccggtgcgcgcggccgcgatcgcgggcctggaggaactggggctggtggtcgacagcgagcgcaacgccgtacggagcgacgagccgcggatcgtctcgcccgaggacgcgcgggtcgcggtcgcggtggtgccgaccgacgaggaactggagatcgcccagcagacgtacgccctcgtgggcacggcgcaccacctcacctgagcggcaccgcgcccctttgtatcttccaccagacggaatattccgtagcgaaacaaaccgataggatcgccctatgcgccgttcgaaaatcgtctgtactctcggccccgcggtcgactcccacgagcagctcgtcacgctgatcgaggccggcatgaacgtggcccgcttcaacttcagccacggcacgcacgccgagcaccagggccggtacgaccgggtccgggccgcggccgccgagaccggcaaggccatcggtgtcctcgcggacctccagggcccgaagatccggctggagaccttcgccgagggtcccgtcgagctggtgcgcggtgacgagttcatcatcaccaccgaggacgtgccgggcgacaagcacatctgcggcacgacgtacaagggcctgcccggggacgtctccaagggcgaccagatcctcatcaacgacggcaacgtcgagctgcgggtcgtcgaggtcgacgggccgcgggtcaagacggtcgtcatcgagggcggcgtgatctccgaccacaagggcatcaacctgcccggcgcggccgtgaacgtgcccgcgctgtccgacaaggacatcgaggacctgcgcttcgccctgaagatgggctgcgacctggtcgcgctgtccttcgtgcgcgacgcgagcgacgtgaaggacgtccacaaggtgatggacgaggagggccgccgggtccccgtcatcgccaaggtggagaagccgcaggcggtggagaacatggaggccgtcgtcgcggccttcgacggcgtgatggtggcgcgcggcgacctggccgtcgagtacccgctcgagaaggtcccgatggtgcagaagcgcctcgtggagctgtgccgccgcaacgccaagccggtgatcgtcgcgacccagatgatggagtcgatgatcaccaactcccgcccgacgcgcgccgaggcgtccgacgtggccaacgcgatcctcgacggcgcggacgcggtgatgctgtccgccgagtcgtcggtcggcgcctacccgatcgagacggtcaagacgatgtcgaagatcgtcacggcggcggaggaagagctgctgtcgaagggcctgcagccgctggtccccggcaagaagccccgtacgcagggtggttcggtcgcccgcgcggcctgcgagatcgccgacttcctgggcggcaagggcctggtggccttcaccaagtcgggcgacaccgcccgtcggctctcccgctatcgcgcggcccagccgatcctggccttcaccacggacgagggcacgcgcaaccagctcgcactgagctggggcgtcgagtcccacgtcgtgccgttcgtgaacagcaccgacgagatggtcgacctggtcgactccgagctgcagaacctgaagcggttcaacgacggcgacgtcgtcgtgatgaccgccggctcgccccccggcgtcccgggcacgacgaacatggtgcgagtgcaccacctgggcgagggcaagcgcgcctgacccgacctgtgtacgcgctggagggcgccccctgcgtgcggggggcgcccttcggcgtttcacttcgaccatgctccgccgcgccgcgaacgccgccgcacagagctgtggccgggttcctcgcggtcctgcgaggaacccggccacagctcttgatgcggctcccggacgggtcggtgggcggcgtcagccggtgatgtactggtggagccccggcacgtgcagcgttccgccgaactggccggcctggatgaccgtcactttggtgaagtagatcagcgggatgttcagcggcggggggttctccgggtcgaacgtgaccgggatcaggccgaacagattgccggagatgctctccgtgtacatgatcgtcttgccgtcactgatggtggacttcgtgccctcgcccgcctggacgtggtaggtcttgccgccgtcgccgacgacgagctggtgcaggtcaccgatctcggtgccctgggagatcacgtacttcaggacctttttgaccttgccgccggccgtgcgcaccttgacgacgccctggtagtcggcaccctcgagcttcagcgaactggccttgagcgtccaggggtcgtcgggcaggttgatgctgttgtcgataccgccctggtcgtcggtggcggccttgcagtccttcgggtccgtggtggagctcgcggacgccgacgggctgggggtggccgaggaagtggcctcgtcggccgcttccttcgccttctccgtggcgtcctcggccgccttcgacgccgtgttcgtcgcgtcctgcgcggtgtccttgaccgtgtcggtgaccttgtcggtcgtgtccttgacggtgtcggaggtgtccttgctcgcgctcgccgaggcggaggccgtcggggtgggggtggcgctcgccgacgggctgtcgggggtgaggacgtccttgatcgcgtcgccgatttcctcgagcacgttgccgctgctctcggacgccgacggggtcgccgtggacgtgtcgccgcccgacgacttgtccgacgtaccggcggaagacgaggacgcggacgcggacgcggacggcgtgggctcggccttgtcgtcggaacctgaatccgacgaagaggtcttgtccgaggacgcggaggccgaggggctcggctccgccgagtcgcccttgtccgacgcgtcgtcggacgcggaggcggacggtgacggcgtggccgacgcggacgcgccgtcctccagggcggcgacgcagttcttgtactcgtcggccaactcgctcttggacaacggctggtcgtccgcctgggcgagcgtcggcgtgaaccccatgcccatgaggaccgccgtcggcatcgccgcgatggctatcgccttgccggcaggcatgtggaacctggtgaacagcggcttcctgggggccgcgtggcgcggtcccgatctcacctgcgccagggccgaagagctctcgccatggacctcatcagccgacacggtaccccccgttggagtcctcggccccggcgccgtgcacggggtccggcaaagggtgtggctcaccgggcccaccggcggcgttctccggagccgttcccgccccgccgtcgcccgcggggtcctggctcgcggcacgccgcccggcgtccgctgccggcttgcccggcgcccaggaagcggacagagcgccgccgatcagcgcgaacaggaagcccaggatgaagccaccgatgttggagaccacgagggacaccagagcgaggacgatcgcggcgacgccggcgaagatgcgcgtggcctgctggaaccacatggtcaggcccagcgtgaacagcaggacgccgatgatgagggagcccgcacccgccgtggtcgccatcgcgatcgacatcgtgcccagcttgagggtggcgtacgggaaataggcgatcggcaccccgccgagcatggtgaaaaggcccgcccagaacggccgactgccccgccagtcacggaatcgcagacgcagccgggtgaagctcccggcgctctggaccgaagtctcggcactcatggaaaacagctccctgggtccggtggaagtacgtaccggctcggccgtaggcgtggagaagccggaagatctgagtctgtgagagtgcccgacgcaaagcgccgggcggggcggcgttcggggcggagaagcgacggcttccccgcccccctggccagctcagctgtccaaggacgcccctacggcgcaagccgtcagaagcactccatcttggagtcggtaccgagacgcatcttcaggccgctgagcttgaaggtgccggcggtggtcgcccacgccgtctgctcgacgccgtagaggtcggcggactccgcctgctgggcgaagccgcccggcagcgcgttttcgccgctcttcacggcaggacccctggtcttgtccttgaccgccacaccgatgtcgatgttcttgaacgtcgcgtcggcgtcaagctgggcgacatcgatgtagagcttctcggcctcgaccttgtgcttgtcgtccggccccgcgtccagacggaggtagatcgtcttccctatgagggggatctccgtcttgaccgactggcacatcttcgtgatctcggccgtgtcgaacgacgaaatcgcgaccggacggaccgtcttggtctttccgtcggtcgacgtgtagccactgtcgataccgccgtactgggcgaagccatcaccgtgcagatgatcggcactgaccttgaactcctggccggaaacgctgaacgacgcggccagcgcaccctgcgcaagcccgacaccaacgcaagcagccgctgcgacgctgggcaccatgaccacagcgaagcgcttccatctggtcccgccacgcacctgggactccatatttcctccttctcggacgtacatctcctggccctggctgcctcctgacggcggctcaaccgggcagggatgggagaagtgctacgtcctcgggaaggagagcgcaggtactcggaggcacgtactgcgcccgaatcaccggcgatcacccccgagcgacaaccactggtcgcgcctgacacacatcacgcacaacctgccggacaggctccaccggacggcggagacccccctgtccaggagccggcgccactggccgccgtctcctgctcggtggggacccaggaaaacccgttgacccggctggctggcggggtacggcaatggaccgagcgtcgccgatcgtggtccattctcgccgcccccgcaagggggttcgttactcgctagtaacgggcggataaccgaacaacgacccgcagatatcggccgacaactctgggtggcgcaaagggagctgacagatacgttgaagtatggacagaatccgacagatccccgcccgtgacttactccaagtaacagcggccgcgattaccaagatttggtaaaacgcgaccgcactgtcacttcggcagcagaattttcactcggccaccatgactcccagcgtttagcgactggtcagaacaacgcccgggccagcgcccggcgggccgccgtcacccggggatcatcggcgccgacgacctcgaagagctcaagaagccgcagccgtacggcgtcccggtcgtcgcccgcggtgcgctgcaccgtctggatcagccgcccgaacgcgtcgtcgacatgcccgcccaccaggtccaggtcggcggccgcgatctgcgcctgcgcatcgccgggcttctcggcggcctccacgcggacccgctgcgggtccgcgtcctgcacccgctgcaacaactcggcctgggcgaggcccagcctggcctccgtgttgcccggatcgtcgctcaggacgttcttgtacgcctgcaccgcgccgccgaagtcgcccgcgtccagggcctgtacggcggcttcgagcagcgcgtcgtaggggccggccggaatcggcggggcctcctgggcggcacccggctcggcgtcggtggcgacggtcagcccggtgagcccgaagcgctgctccgcgacctcgacgagctggtcgagtgtgccgcggatctgctgctcgcccgccgcaccctggaagaggggcagcgcctgcccggcgacgaccgcgaacacggccggaatcccctggacgccgaactgctgcatcagcatctggttcgcgtcgacgtcgatcttggcgaggacgaaccgtccgttgtactcgacggccagccgctccaggaccgggctcaactgcttacagggctcgcaccactcggcccagaagtcgatgacgaccgggacctcggtggaccgctgcaggacatcgcgctcaaaacccgcctcgtctacgtcgatgacgaggctcgatggaggcacagcagagacggctgtacccccgccgccctgcctggccgcttcggcgcgcgcctgctccgccttcgccttggcctcctgggccgccttcaccgcggcgaggtcgacgactccgctcatggacatgttccgtggctgcatgagtacatcctcccccttccgcgcccgcgtgtgaaaagcgttgtgaaagccagacttggcacatgatgatcggcgccgggtccccacctggcgccagtggtcgtcgctcgcgtgcgagtcaccgcgcacgagctttcgctacgagtcgtagcgtaactgtccccgggggcccgtgtgacccaccccccggtgatctccctcaccacttcacacgatcgccggatatggtcgccgacatgcagtgccgcacctccgccccccgtacggggcgtccacgcagcgccgccgcggacgccgcgatcctggcggcgacgcgggaggcgctggtcgaactcggctggtcgaagctcaccctcggagacgtggcgacccgcgccggggttgcaaagacgacgctctatcgccgctgggcgggcaagaacgagctcgtggtggacgccgtggccgaactcttcgacgagctggaactgcccgatctgggcagcctggccgcggacatcgagggagtcgtccttcagttcgcggcgatcctggcccgcccggaggcgcggagcgggctgatggcggccgtcgccgagtcgacgcgcgacgacgccctgcgcgagcggatccgcgcctcgatcgtcgaccgccagaaacggctcgtcctggccggccggtcccgcgcccaggcccgcggggagctgccgcccgaggaggacgcacaggaggcggcccgcaccgtggacctgatcttcgacatggtggcgggtgcggtggtccaccgcaccctggtgagcgcggagccggtggacgcggcctgggcccagtccttcacccggatcctgctgctggggctcgccggggcgtcagccggcccgcacggcgcctgaggacgacgccgtacgggccgtagcgcggtgcggggccgcacacagggcccgcaccgggcgcctgaacgtctgacacctgacttctgacgcctgacttgtggcgcctgacttgtggcgcctgacttgtgacgcctgacttctggcgcccgacttgtggcgcctcagaaaccggcgggctccgtgtagaccccccactcctcccggaggacatcgcagatctcgcccagcgtggcctccgcgcggaccgcgtccagcatcggggcgatcatgttcgacccgtcgcgcgcggcggcgagcatcgcgtccagggccgcggttacggccgtgtcgtcgcgccccgacttccgctcgcccagcacccgcacctgctcgcgctccacctcgtggctgacgcgcaggatctccaggtcgcccgtcacggacccgtggtggacgttgacgccgacgacccgcttgtcgcccttctccagcgcctgctggtactggaaggccgactcggcgatctccccggtgaaccagccgtcctcgatgccgcgcaggatgccggaggtgatgggcccgatcgggtgccgcccgtccgggtgggcccgcagcccgcgctccctgatctgttcgaagatcttctcggcgtcggcctcgatccggtcggtcagctgctccacgtaccaggaaccgcccagcggatcggccacgttggcgacgcccgtctcctccatcagcacctgctgggtgcgcagggcgatctcggccgcctgctcggacggcagggcgagggtctcgtcgagggcgttggtgtgcagcgagttcgtcccgccgagcaccgcggcgagggcctccacggccgtccgtacgacgttgttgtacggctgctgcgcggtgagcgagacgcccgcggtctgggtgtggaagcgcagccactgcgccttctccgacttcgccccgtacacgtcccgcagccagcgcgcccagatgcgccgcgccgcacggaacttggcgatctcctcgaagaagtcgacgtgcgcgtcgaagaagaaggagagcccgggcgcgaacacgtccacgtccaggccgcggctcagccccagctccacgtatccgaaaccgtcggcgagggtgtacgccagctcctgggcggccgtggcaccggcctcccggatgtggtacccggagacggacagcggcttgtacgcggggatcttcgaggcgcagtgctccatcaggtcgccgatgagccgcagatggggctcgggctggaagagccactccttctgcgcgatgtactccttgaagatgtcggtctggagggtgccgttgaggacggaggggtcgacgccctgccgctcggccgcgaccaggtacatgcagaagacgggcacggcgggcccgctgatcgtcatcgacgtcgtcacgtcacccagcgggatgtccttgaacaggacctccatgtcggccgccgagtcgatcgcgaccccgcagtgcccgacctcgccgagcgcgcggcggtcgtcggagtcgcgccccatgagcgtcggcatgtcgaaggccacggacagcccaccgccgccgttggcgaggatcttcttgtagcgctcgttggtctgctcggcgttgccgaacccggcgaactgccggatggtccaggtccggccccggtagccggtcggatacagaccgcgcgtgaaggggtactcacccggccagccgatccgctcgaaaccctcgtacgcgtccccgggccggggcccgtacgccggctccacgggatcgccggagagcgtggtgaaatcggcctcgcgcttgcgtgaggcgtcgtagcgggcctgccagcgtcggcggccttcctcgatggcgtcagcgtccatacccacgaatttactaggacgtcctagtaaatgtcgatgggggaccgccgtacgtgtacccgtacggcggtggctactaggccttcgcgaccgcgggagcgtcgtccgcgaccctcggctccagctcgcgggagatcctgcgctccacgaagaacgcggccgtcgggatcgtgcccgccagcagcacccacagctgcttggcgaccggccacttcgccttggcgcccaggtcgaaggcgaaaacgaggtagacgacgtagagccatccgtgggcgatggccacgacccgggtgaagtcggcggcgccgtcgacgtcgaagccgtacttggcgatcatgctgagacacagcaggaccagcagcacgccggtgacgtaggccaggacgcggtagcgggtcagcacgctctttttcatgcgtacgagcgtaaccgccggtttgggccgatcttgcgccgcccccgaggacgtacggcggtgtcctactcctcgtcgaagtcgtgcgcggcgatgcgcagcgggcgcagcatcgcgaagatctccgcgcactcctccccgtcgtaggcaccgagcccgaagtccatcgccatcaggtcgcgggtcgccgcgtcgcagacctcgcggcccttgtcggtgatcgaggcgagggttccgcgcccgtcgttcgggttggggcgcttgtcgacgagcccggacgtcaccagccggtccacggtgttggtgacggacgtcgggtgcaccatcaaccgctcgccgatcttggacatcggcagctcgcccgccttggagaaggtgagcagcaccagcgcctcgtaccgcgcgaaggtcagcccgtacggcttgacgaccgcgtcgacctccgccagcagaatctggtgcgcgcgcatgatcgaggtgatcgcggccatggacggcacgtttccccagcgctgcttccagtgttcgtcggcgcgcgcgatgggatcgaaggcgagactgaggggcttcggcacggcaatagaccttaccggccggtcatatcgcggtcagccccgtctcgcccttcggtcgccgcccgtccgtacgcccggccgccccggccggcagttgcgcggcgggccggcccccgcgcccccgcgcgcgagactcgaacgcctcgcgcgcgggggcgcggccggcaccgccgtactcaccgcgctcgacgagcccgccaccacggcggtgcccgccgagcgcccgcggccggcggcgtgtgcgatccctcaggccaggtccagcagggaggccatgatctcgtacagcgtcgcctccggttcggccagcgggccctcggaccgccacgccacatacccgtcgggccgcaccagcaccgcgccccgcggcgtcgtgccgtggagttcggcccagtccgtgccgttctcggggacgagctcggcgtgcgggtccttgccgatgcggtacgagtcgaggcttacggcgaggcgctcggcaacgctggtcgccgcccggtgccaggcgtcctcggcagccccgctgagcaggacgaacgagcgctcgtacagatcgagcgtggaggtgcgggcgccggagcgcaggagccacatgtgcggggcgcggctgccgggttcgccggccatggccatctgctcgggcacgaccgggcccgccgggtcggcgccgatgacggcgccacgcggatagcggtagcccagggccaccttgaggacaccgccctgacgtccgccgccaccgccgcccgcgccgggagcgggggcgtagcccggatggctgtgttccgcggaacgggccgaggcccgcgcgctcgtcgcctgcgccactgggagacgctcggcctcgtaggactggagcagcccgggcccggcccacccgttcagtacggcggcgagcttccaggcgaggttgtgtgcgtcctggataccggtgttggagccgaacgccccggtcggcgacatctcgtgggcggagtccccggcgaggaagacccgttccgacgcgtaccgctcggcgacccgctccgccgcgtgccagggcgccctgccggtgatctcgacgtccatgtcgagatcaccgacggcccggcggatgtgggagacgcaccgctcgtcggtgaagtcctccagcgtctcgccctgctcggggtgccagggagcgtggaacacccacttctccacgttgtccacgggcaggagcgcgccgtccgcctccgggttcgtcaggtagcagcagatgaagcgccggtcgcccaccgcgtccgcgagtgcgcgggagttgaaggtgatgctcacgttgtggaacaggtctccggggcccgtctggcggatgcccaggcgctcgcggaccgggctgcgcggcccgtcggccgcgatgaggtactccgcccgcaccgtggtgtgcgcgccggtgtcccggttcttcatgagcgcggtgacgccctccgcgtcctggtcgaaggagagcatctcggtggagaaccggatgtcgcccccgaggccgcgggcggacttcagcagcaccggctccaggtcgttctgactgcacagacaccatccgctcgggctgaagcgggccaggccgccacccgggtcgatctccttgaacagccactcgccctcgtcgtcggtcagggacgaggtctgcaggatgccgtggttgtccgccagggtcgacgcggccttgcggatcgcttgttcggccccggccacccggaacagctccatcgtgcgcacgttgttcccgcgcccacgcgggtgcttcgaggtgcccgcgtgtttctcgaccagcatgtgcgggatgccgagccggccgaggaacagcgaggcggacagacccaccagggatccccccacgatgagaaccggcacgtggtggtcgacttcttcgttcatcaatgcctccagcagcggaccccggctacagggcttccatggacccccggctacagggagtccatgccccgacgggaggggttcgctcgccccattcacccggctggttcagcctctgttccacccgcttcacccgtgcggtttcacccgcttcacccgtgcggtcacccacgtggttcacgcgactcgcgcgatgctccgggccgacccacgatcgggatccgggctgatcgccgtccccgacaccgggggcgtacccgggcatccggcgatcggccctgtgaatccacgacgcctgacgctgcttcacaaggcttggcgcccgggctgtccctaaggagatgggtgctggatgacaacttcggaacgtgtatcgcagtccgcgttcgacggctcccggctgcgggtcgtcctgctgctggacctccatgacggcgcccagaagcagttcctggaggcctacgaacaactgcgcaaccaagtggcctccgtgccgggccacatcagcgaccagctgtgccagtcgatcgagaatccctcgcagtggctcatcaccagcgagtgggagagcgccccgcccttcctggcgtgggtgaacagcgaggaacacgtcgagacggtccagccgctgcacagctgcgtccgggacacgcggtccctgcgcttcagcgttctgcgcgagacggggaacatctccgcgccgctcccccagtcggagaagggccgcctccaggcgacggcacgggtgggcgacggcgtcgtgcgccacgccctcaccttcaccgtgaagccgggcagcgagccgatggtcgccaagatcctcgccggatactcctcgccgcaggcgcaggtcgacgagaacacccgactgcgccgcacctcgctcttcatgcacggcaaccgggtggtacgcgccatcgaggtggaaggcgacctgatggccgccctgcgccatgtgtcccggcagcccgaggtcatggcggtcgaggaggccatcaacccctatctggagcaggaccgggacctcagcgatccgggatcggcccgggtcttcttcacccgggcggcgctgcccgcggtgcaccatgtgtcggtcggcaccggcgagccgtcggacgtggagcggcacgcgctgttctacccggccaagagcgggtccggcatggccctggcccggctgctcgcccgcgaggacgaggcggcggccgacgaccccgccaaccccatccactgcagcaccatcttccagcgcgacgacatcgtggtccgtctggtcgatgtgcggggcagcatcgaggacgaccccgtcctggccctcggtctcaagggcgaccgcaacggcgcggtcctgtcccgcctgctcgacgccgacgcgctcggcgtcgacggtgcgccgacgaccgagaaggagatctcgcgcttcctcgagcggtccgacatgcaactgatcaccgaccgcagctcatcagcctcctgaccggagcgtccggcccggtccgcggccggacgcgcactacgccgtcggcacacatcaactggaggaaccgcacatgaccacgccccgcccacgcatcgtggacctcagcgagaccgagcccaacaccaggcgcggaggtgatctgcgcgccatgctcacgcccaccgcggtgggcgccaagagcggcttcatgggcctcgccatcgtgcagcccggcgaacgcatcggcgagcactaccacccgtactccgaggagttcgtctacgtcgtgagcggtcggctcgaagtcgacctggacggcgagacgcacccgatccagcccgaccagggcctgctgattcccatcaacatgcggcaccgcttccgcaacgtgggcgacgtggaggcccgcatggtcttccacctgggcccgctggcgccgcgccccaagctcggccacgtcgacaccgaggagaccgacggcctggagggagccggacaggcgatgacaccacagcgaaccgaggccgtgtcatgacccggcgcgtggcggtcaccggcgtcggcatcgtcgccccgggcggtgtgggcgtcccggcgttctgggacctcctggcgaacggccgcaccgcgacgaggggcatcacgctcttcaacccggaaggtctgcgttcgcgtatcgcggccgagtgcgacttcgacccggccgcccacggaatcgacgcggcggccgctgagcgcgccgaccgctatgtccagttcgccatggtcgccgccagggaggcggtgggcgacgcgggactcggcccggagaaggaagacccctggcgcatcggggtgtccctgggcaccgccgtcggtggcaccacgcgcctcgaacacgactatgtcgcggtgagcgagaccggccggcggtgggatgtcgaccaccgcctggccgacccccatctgcaccgcgcgttctcacccagcaccctcgcctccgaggtggccgaacagttcggtgcccacggcccggtgcagaccgtctccacgggctgcacctccggcctcgacgcgatcggctacgccttccacgccgtacaggagggacgggtcgacgtgtgcatagcgggcgcttcggactcgccgatctcacccatcacgatggcgtgcttcgacgccatcaaggcgacctccccgaacaacgacgaccccgagcacgcgtccaagccgttcgacaagcaccgcaacgggttcgtcatgggcgagggcggagccgtcctgatcctggaggagctcgaacacgcgcgggcccgtggcgcacgtgtgtactgcgagatcggcggctatgccaccttcggcaacgcctaccacatgaccggcctcacccgtgagggtctggagatggcgcgtgcgatcgacggcgccctcgcgcacgcccggttggacggctccgacatcgactacgtcaacgcccacggctccggcacccagcagaacgaccggcacgagacagccgccgtgaaacggtccctgggcgaccacgcgtaccggacgccgatgagttcgatcaagtcgatggtgggccactccctgggcgccatcggtgcgatcgaggtcctggcctgcgtcctggctctcgtccatcaggtcgtgccgcccacggcgaactacacgaccccggaccccgagtgcgacctcgactacgtgccgcgcaccgcacggcaggtcaaactccgcaacgtgttgtccgtcggcagtggcttcggcggcttccagtccgcggtggtgctgacccgcccagatgggaggacctgatgaagccgcagcaaaaacggcgtgccgccatcaccggcataggcgtcgtcgcccccaacggactgagcaccgagaccttctggaagtccaccgagaagggcctctgtgtactggaccgggtgacccgcgaggggtgcgaccatctgcccctgcggatcgccggcgaggtccgcggattcgacccggtggcgctgatcgaggagcggttcctcgtccagaccgaccggttcacccacttcgcgatggccgccgccgacctcgccctggaggacgcccggctcggccgcacctacaccggcgacgagccgttcgggatcggcgtggtcaccgccgcggggtccggcggcggcgagttcgggcagcgcgaactgcagcggctgtggggacaggggcccagattcgtgggcccgtaccagtccatcgcctggttctacgcggccagcaccggccagatctccatcaggggcggcttcaagggaccgtgcggcgtcgtggccagcgacgaggccggcggtctggacgccctggcgcacgccgcccgagccgtccggcgcggcaccgacgtggtcgtggccggtgccgccgaggctccgctggctccgtattcgatggtctgccagctcggctacgaggacctcagcaccagcgacgacccggcctgcgcctaccggcccttcaccggcgctgcctgcggattcgtgcccgccgaggggggcgccatgctcgtcgtcgaggaggagacggtcgcacggggccgggaggccgcgatccgggccttcgtcgccgggcacggtgcgacgttcaccggcgcgtcctgctgggcgcagtcccgggagggtctggcgcacgcgatacgcgacgcgctgaacgaggcccggtgcgcgcccgaggagatcgacgtcgtgttcgcggacgcgttcggcgtaccggaggccgaccgtgccgaggcgctggcgatcgccgacgtcctgggcgcacagggccggcgcgtgccggtgacggcacccaagaccggcatcggccgggcgtactgcggagcgccggtgctggacgtggcggcggcggtgctcgccatggaacacggtctcgtaccgcccaccccgaacgtcttcgacccctgctacgacctcgacctggtgaccgggagcgctcgccccgccgagctgcgcacggcgctggtcctcagccggggactcatgggctcgaacgcagcgctggtgctgcggcacggcgctcatgccctctcatgagaaggagaaagagatggacaaccaactgaccgtccaggagctggccgctctgatgaagaaggcggccggcgtcacggtggacgtgaaggagctggaggaccggctcgactccggcttcgccgagttcgggctcgactcgctcggcctgctgggcatcgtcggggagctggagaacggccacggcgcggtgcttccccccgacgcggagcgctgccggaacccgcgcgagttcctcgacctcgtcaacaacaacatcgtcgctggagcctgatgtgtctggacacaccgagaacgacatcatcatcgccgcccccctggacctcgtctgggacatgaccaacgacatcgagagctggccgcagctgttcagcgagtacgcgtccgtcgatgtcctgagccgggagaacggcacgaccaccttccgcctcaccatgcacccggacgagaacggcaaggtctggagctgggtctcggaacggacgcccgaccgggagaagctgacggtcacggcccgccgcgtcgagaccggccccttcgagtacatgaacatcaggtgggtgtactcgcagacccccgacggcaccaggatgcactggacgcaggacttcgcgatgaagcccgaagctcccgtcgacgacgcctggatgaccgacaacatcaaccgcaactcggtcgtccagatggaactcatccgggacaaggtcgaacagcacgcccgcgagcgcaggaccgcttccgtcaccaccgactgatccccgacgccggaccggccgcggaccgcccccttcgggcggtccgcccggcttggcgccgacgaaaggaagttcccccatgcaccaagccctgatcgtggcccggatggcgccgggttcggccccggacatcgcgaaggtgttcgcggagtccgacagcggcgaactgccgcacctcgtgggcgtcacccgccgcaccctgttccagttcaacgacgtgtacatgcacctggtggaggcggaccggccgcccggccccgcgatcgccgaggtggccggccacccggccttccgggacatcagcgacaggctctccacctacgtgagcgcgtacgacccgacgacgtggcgcagcccgaaggacgcgatggcccaggagttctaccgctgggaacgcgagagctgagggcctgataggcctgacacgtgacaagggcccgcccccggcatcagccgggggcgggcccttgtcacgtgtcagggtcacgtgtcaggtcgggtcaggcaggtacggtgcattcgaacgcgtgcaggtacgcgttgaccggccggatctcaccgacggtcagaccggcctccgtcatgcgggtgaccaggctttccttggtgtgcttggctcctccgacgttgaggagcagcatcaggtccatggacgtggtgaacttcatcgacggggtgtcgtcgacgaggttctcgatgatgacgaccctggctccggggcgggccttcgtcatcacgttccgcagggttctgcgggtgctgtcgtcgtcccattccaggatgttcttgatgatgtacaggtcggcctcgaccgggatctcctcgcggcagtccgcgccgacgatccgggcccgcgcggcgagcgggccgccgtcacgcagccgggggtccgccttctccaccacgcggggcaggtcgagcagggttccccggatgtccgggtgcttctccagcaggctggcgagcacatgtccctggccgccgccgatgtcggcgaccgtcgacacgccggtcaggtcgaggagctccgcgacgtcccgcgccgactgctcgctggacgtggtcatggcctggttgaagacctgggcggagtcgtgcgcgtcctcgtgcaggtagtcgaagaaccccttgccgtacagctcgtggaagacgctgccgcccgaccgcaccgcctcgtcgagccgcggccaggcgtcccaggtccagggttcggtgcaccagagggagatgtaccgaaggctgtgcggatcgtcttcgcgcagcagccgggacatgctggtgtggacgaaccgtccgtcgtcgttctgcgcgaagatgccgtagcaggacagggcccggagcagcctcagcaggggccgcggctcggtgcccagcacggccgcgagttcttccgcggtggcgggcttctcgccgagcgcgtcggcgacgccgagcttggccgccgcccggacggccgcggcgcacgccgccccgaagacgagctccctcagctgcatggccggggccggctggggggcgggactcactgtggtcatttaccgtctcgattcgcttggtcgagcagacaggcgggccggccggtcagcacatgcccgcgggttcggagcgctgacacgagttgtgctcgaacttgttgccggtgccggtgtcccggttggccaggtcggccgtcgaattacccgacagcacgttgtcccggatgacattgcgcttgttcggcgtgccgacgaagctcttgtacagcaccactccgccggagaacacggacttgcccacgttgtctcggatgtcgttgtactccacgaccgtgtcctcggtaccggtgagaacaattccggacccctggatgtagggcagccgagccgtcttcgcgcagtatttgttgttctcgtggacgccattgccccgaatggccagggctccggcgtgcggcttgccctcgtcgcctacggcgaacagcccgctgcagttcgcgctgagttcgttctcctcgacggtgacattccgcagacgcctgacggtgagtccgatccggttgccctccagcctgttgtggcggacgacggtgccccgcgtgtccgtggcgccggcctcggtgtccaccgtgttggagaggaacacgcccgactcggcgtttccccgggcgacgttttcctcgagcacgctccggacggaccgctcgatggcgatgccccagttcttgttcttgtctgcggccacgtcccgcacggtcagcttgtcggtgttggacgcccacaggccgttcttcttgtagccggtcagcgtgagcgagcggacgctggtacgcgtgacggggtgggcggacgtgccctcgacgcagatcccgttgccggcggccgcgcacttgtcggcggccctggtcgccgccggcatcagcacggtccgctcccccgccccgcggatggtcagaccggacttcgtgacgaggacgctctgatggtaggtgccgggcgagatgacaatggtgtcgcccgactgcgcggcatcgaccgctttctggatcgattcccccggatgcacgacatgagcagtcgcggcattggccgccgggatacagctcagtcccgacgccaccacgattgcggcgcaaccgaggtatgcgaaatcttttttgttcatgggtcgaagttatggtccatcaatccgacccgccatgtgtggtcacccgtttactgcacgtcgggcgcgaatggcccaatccggagcctgaaagggcgtcatgacccctctgttcaggagggccggggccataaatccggcttcgtctatttcgagttcggccggggtggccgaggccggaatggtgaagcggccggagtggtgaggcggccggagggttccagccccggcgccggtgcgcggggtcagccgcgggtggcccggcgcagggtgtggcggaccgcgcgctgggcgaccgggcccaggtcctccaacgccgtcagcaggagtgccaattggtccagtgccgcgagggcggccccggccccttccgcgtccaccccctcgtacagctcgatccccacgaacgacgccgccaccgcccgcgccagccccgccgggtcggcgaactcgcccagcggggtcggggtcaggacgcgggtcagcaccttctcgatctccgcgatccagaggtcgaggccggccgccgtcgcgggtgcgaggcgtggctgcgtctgggcgccggcgagcagctggccgagcatcgccacatggccctcggccttctcctgctcgtgcagctcgcggcccagcgcgaggagctcggccagggtggcgacctcgtccagccgtgcccggtagcgcgccaccacctgctctgcgccgtgccggcaggccgcggccagcagttcgtccaccgatccgaagtggtagaagacgagcgcctggttgactccggcggccgcggcgatcgcacgggcggacgtcttggcgatcccctgctcggagagcgcccgcagcgctccttcgaggagcttcgtcttcgtcgtctcgctcacgcccgccgctcctcgcggacgggacgcaggccggggcgcacgccacaggtgcggatgtccgtgtagtcggcctcgaacgacccctcgtagccgaagagcgggccgacgtaccggttcacgacccggacctggatacggaagcggcccgtccggtcgtcgaaggactcgcgtacctgagcctcgccgccgatgagttcggggacccggacgtcgaccggcccctcgcggaagcggtgttcgcccgagcggatcagcagcgaaccgtcgggctcggcgcggaagtgcaggtcgctggcgaggtgctggtgcgtgccgaggtagtcgaggacgcggtcgcccttggggctcagcaccatctgggcgtcgaagcggcgggggccgccggggaggtcgaaggtgcgcacgaacgtcaccgtctcacggccgaaggtgtccttgtacggcacgttctcgatggtgaacgggatccgccggcccgcgcgcgggaccaggatgttgcgagtgccgccgagggccaggaacggcttcacgaagcgcccgccgtgccagatgcgctccatgacgccccgcccggtgcaggcctcgccgctcgtgaggcccaccgagaagcggcgccgcagttcggggtggaggcggtcgaagtccgcgcccatcaccgtacggaagatcgacgtcatgactgccgctccagggtggcgagaaggcggggtgcgcgcgtgcgggtgggcggggtgcgcagacagcggcgggcggccggggtgccgggcgcgggcggcaggaacagggccagcgctacggccacgctcgccagcagcggcatcgcgtagcagagcatcggcgcgaaggggccggtgagcaggaggagccggccgaagccgaagcccgtgcagcccgcggcgatcaccaggacacgcagggccagttcggcggcccagcggcgcagcgcccgctccggtgtgatgccgcgctccagccagaggcgcaggcggtcgaaggaccaggccgtggcccagcccatcagggggcggaacagcaggcggtcggtggcgactccgaccaggccccatcgcgggcggtagtcgtagcccgtgaggaagcggatcccgtccccgtcgggaacgtagcgccagtagccgcttccctcggcgagcagggagagggggtgcggggaggcgaagcgcagggcggaggtgcgggtgccgtccgggcgctccttctcaccggcggacacgccggttccggcgatcgtcaggaacggcagtacgcgggtcgcgtaccggaagcgctgcggctcgccctccccgcgcgcgaggtagtcgatctcggtgaaccgcaggtcccagcgctggtggcgcgcggggtcctgggtgtgggtccagaggtcgtccaggtcgcgtcgtatgcgtgtctctatgtagagccccatccggaatcccccaggtcagtggctactgcgcggcttcttttgagcgagtgctcaaatgcctggccctgaagatacagctgtttgagcgactgctcaaacagtcgggcgcaagagaaccccggcccaggaggaccggggttccgcgcagaaggggtgcctctgggcctatgcggacaggtggcgctccaccgtttccaccttggaggtgaggccgtccgacacgcccgggcggatgtccgccttcaggacgagggagacacgcggcgctcgctcctccaccacggcgacggcgcgcttgacgacggccatgacctcgtcccactcgccctcgaccgacgtgaacatcgcgtcggtgcggtggggcaggcccgactcgcgcacgacccggacggcgtccgcgacgtactcccccacgtcgacgccgacgccgaggggggtgacggagaaagcgacgatcatgcgttcaccgtcccttcccggcgggcgcgggaggcgatgaccgcgtcctcggcctcgcgcttgagcttgcgctcggcgaaaaggccgccgaagggcgggatcgccagcaggaagtagccggcggccttcttcttggaccacttggcgcggttccaggcgtccgcccagaagatcacgtagaaggtgaacagcaggccgtggatcaggcccatcgggaagacagcgtcgaactcggtcgtccgcttcagcaccgagcagaccagcaggatcgggaacgagatggcctcgggcagcgagatgagcctgagtcggtggagtgcggctgcggtcttgacgtccacgggcaggaaaccttcgtcgtcggggcaccggtgatcaccttgtgaacgagcgcacaaggccgcacccattctgacaccctccccgtcgcccctcgcttcagggccttctcacggtccttgtccccacataggacctgtcggcggcaccccgctgcggttaccttcacaccgtggcgatgttccgacttcaaggcagcaaggtgctggccgtcgacatgaccggggacgccgtgaaggcgaagaacgggtcgatggtcgcctacgacggccagatggcgttcaagaaactgagcgggggcggtgaggggatccgggggatggtgacccggcggctcaccggcgagcagatgacattgatggaggtgaaggggcaggggacctgctggttcgcggaccgggcttccgagatcaacctggtgagccttcagggggacaagctgtacgtcgagtcgagcaatctgctcgcgaccgacgccgggctgcggacgggtacgtccttcaccggcctgcgcggcgcgtcgcagggcaacggcctgttcacgacgaccgtcgaggggcacggccaggcggcgatcatgtcggacggccccgcggtggtgctgcgcgtgagctcgcagtaccccctgacggtcgaccccggggcgtacatcgcgcaccaggggaacgtgcggcagtccttccagtccggtgtgacgttccgcacgttcatgggtgagggcggcggcgaggccttccagatccgcttcgagggtgacgggctggtctacgtacagcccagcgagcgcaacacgatcgcgggggatgtgtgacatgcccttccgcgagatcaactccaagatgatcgaggccaccgtcgccccgggccagcggctgttcagtcagcgcggcgcgatgctcgcctacaagggcgaggtgtccttcacgcccaacgtccagggcggccagggcggtgtgatgtcgatgctcggccgccgcatggcgggcgaggccactccgctgatgacggtggagggcagcggcacggtgttcttcgggcacggcggccatcacatcgaggtgatcaacctcacgggcgacaccttgtacgtcgaggcggaccggctgctcgccttcgacggcacccttcagcagggcacgatgttcatgggctcgcagggcggggtcatgggcatggtccggggccaggtgacgggccaggggctgttcacgaccacgctcaagggtcatggcgcggtcgccgtgatggcccacggcggggtcatcgaggtgccgatcaccccgcagcgcccggtccatgtcgacccccaggcgtacgtggcgcaccacggcgacgtacgcaacaagctgtccacggcgctcggctggcgcgacatggtgggccgcggctcgggcgaggcgttccagctggagctgagcggcagtggtgcggtgtacgtccaggcgtcggaggagaagctgtgagcgcgtacggggccgcgggcccggtgatccacgacccgatgacgctgccggtcgacgacaacgtcaacaagtacaccttctgcgtggagctcaaggggagccagtggttcctgcagaagggcaagatgatcgcccactacggctcgatcgatttcaacggcatcggacacggccggctcgaccggctcgtccgtacgtcgttccattcgccactgcacgcgagcgactgggtcgtggcggagggctccggcaagatgctgctcgccgaccgggccttcgatgtgaattcgtacgacctggacgacggcaatctgaccattcgctccggcaacctgctcgcttttcagccaagtctcgcgctcaagcagtcgatcgtgccgggctttctgacgctgatcggaaccggcaagttcgtggccgcgtccaacggtccggtggtgttcatggaaccgccgatccgggtggacccgcaggcgctggtcggctgggccgactgcccctcgccgtgccatcactacgaccacgggtacatgacgggcgtcatgggcggtctacgtgcgatgacaggcctgggcggggcctccggggaggagcaccagttcgagttcgtgggggccggcaccgtgctgctccagtccacggagacactcatggccgagcaggccatgggggcggtcccgcaggagcccggagtaccgggcggtggcggggtgcctggtcaccagggacagcaagccggcgcaccgcgtcttcccggacagctgggggacctccagcgtcgcttcgggctgtgagcggtagtctgcggagtgtgacgtcgaacgcgtgcgcacagtcacaccaccctcactagttcgcctttcaaccttttaggtagacttcattcatggagaccgagacggccacgcgctggctgaccgatgcggagcagtgcgcctggcgcacccacctggaggtcaacaggctgttgacgtaccagctcgagagggacctgcagccgttcagcctgacaatgaacgactacgagatcctggtcaatctctccgagtcggagggcgtgcggatgcgaatgagcgacctcgccgccgccaccctccagtccaagagccgcctctcgcaccagatcacccgtatggagaacgcggacctggtacgccgcgaaaactgcgagtccgaccggcggggactgttcgcggtcctcaccgagcacggcatggagaccatgcggaaggtggcgccgcatcatgtggcgtccgtgcggaggcacttcatcgacctcgtctcgccggaggcgctggaagagctccacaaaaccctgcggcccgtcgccgaacacctccgcgcacagcggggcaagccgtagcgctccgcggggagagcgttccgggaacccgcctgcggcggccggtcgcgcccccgccgcggaaccgcgacatgccgctgccccgcccccctttcggggtgcggggcagcggtcatgcacgggtcgttcctgccgcatttccgggggcttcccgccgcgtcgtctccccgcgtgcgccccgtgccgagagcaggccggccgcgatggccaccgtccccgagaccgcgaagcacagcgccggggacacgtggcccaccagcagacccacccccgcggcgccgcccgcgttcccggcgttcaccgccgtgttgacccaggcgcccgcccgggtgcggtggccgggcggggccgcgtcatcggcgatcaggtaggacgtggtgagggccggggcgacgaagaagccggcgcaggccacggccagggccagggtgccgaggccggagccagccccgcggcgagcagggcgaggcccaggccacaggcctgcaacggcaggcgcacccgtgcggacgtacgccagtcgacggcgccgttgagcaggccgcccagcgcgctgcccagggacagcgcggcgagcacccaggccaccacgtcgtccccgtgacggtgctgctgggcgaaggccatgacgaggaggtcgacggcgcccagggacaggccgacgcccgtcgcgacgacgacgggctgcacgagcgcgcgcccaccccggggccggcccccggagcgcgccgccggcttcgccgcggccggccgtacgcccgccacgacgggcgacagcgcgaacgcgagggttccggcccacaccagcagggcgctcagcgcgaccccggcggccggcggcgcgcaccggacgaccacgccgaccagcagcggcccggagacgaagaggatctcctccgcgacgccgtccagactgtacgcccgctgcaacagcagtttgtcctcgacgacttcgccccagacggcacgcatcgtggggcctagaggtggcgtgcaggcgcccgcggcggcggccggcgcgccgagtgccaccgacggcgctcccggcagccaggccgccgccgcgaaggccgcgagcaggccggcgtagagcgaggccatggggatcagggcacggcgggggccgtaccggtcgatcagggccgccctggcgggcgacaggaccacgctcatcgcgccgaacagcgccatgaccgtgccggccacggcgtacgacccggtcccccgggccaccgtgagcgtcatggccagggagacgacgccgtacgacagccggccgacgagggcggccgtgaaggtgcggcgggcgtgggggatgcggaggagcgcggcgtacgagggccgcgcagatgacgcagacatatggacttgttcctcgacagcgaggcggaaaggggacgccgtggtgccgcgacgaccgcagccggactgctgcttgcccgtcgcgggaccgggcgggccctatgccaagaggaggaacatgcggtgcaacctaacagcgggcgctcggagttgaccaggggaagagcttctcgcccctcacctcagccctccgtcacgccctccaccagtgaatccgcggcccgataggggtccagctcccccgccacgatccgctccgcgagcgcgctgaggcggcggtcgccgtgcaggtcgccgatgcgccggcgcagagccgtgaccgcgatcgtctcgatctcctgggaggcacgggcgaggcggcgctcggtgaggaccccgtgctcctccatccacgcccggtgcttctccagcgcctcgaccacctcgtcgatgccctcaccacgcgccgcgaccgtcttcacgatcggcgggcgccagtcccccgggccccgcgactcccccagtcccagcatgtggttcagctcacgtgccgtcgcgtcggcgccgtcccggtccgccttgttgacgacgtacacgtcaccgatctccaggattccggccttcgccgcctggatgccgtcgcccatcccgggggcgagcagcaccaccgacgtgtccgcctgtgaggcgatctccacctccgactgcccgacgcccaccgtctccaccaggatcacgtcacagcccgccgcgtccagcacccggatcgcctgcggagccgcccaggcgagaccgcccaggtgtccgcgcgtcgccatcgagcggatgtagacacccgggtccgacgcgtgctccgacatccggacccggtccccgagcagcgcgcccccggagaacggggaggacgggtcgacggccagcaccccgacccgcttcccggccttccggtacgccgtcaccagcgcggacgtggacgtcgacttgccgacgcccggcgaccccgtcaggcccaccacgtaggcgttgcccgtcagcggcgccagggcctccatgacctcccggagctgcggggacgccccctccaccagggagatcagccgggccacggcccgcggccgaccttccctggcctgggccaccagcgaggagacgtcctgcatcacagctccgttcagcgtcgtacagaggtcgtacagaggtcgtacagaaagggcagacgtgtcagacgtgtcagaccttgggtacccgcacgatcagcgcgtcaccctgcccgccgccaccgcacagcgccgccgcgcccacgccgccgccccgccgcttcagctccagcgccaggtgcagcacgagccgggcaccggacatgccgatcgggtgtcccagggcgatcgcgcccccgttgacgttcaccttttcggtggacaccccgaggtccttcatcgactgcaccgcgaccgcggcgaaggcttcgttgatctcgatcagatcaagatcgtcgaccgcgagaccctccttcttcagcgcgtgctggatcgcgttggacggctgcgactgcaaagagttgtccggtcccgccacattcccgtgggcgccgatctccgcgatccactccaggccgagctcctgcgccttggccttgctcatcacgaccacggccgccgcaccgtccgagatctgcgaggaggaaccggccgtgatcgtgccgtccttggtgaaggcgggccgcagcttgccgagcgactcggccgtcgtctcgccgcggatgccctcgtcctggctgaagaccaccggctcaccgcgccgctgcggaatctccacgggcgtgatctcggcctcgaagatcccgttcttctgcgcggcggcggcccgctggtgcgacagggcggccacggcgtcctggtccgcgcggccgatcccgagccgcgtgttgtgcttctccgtggactcgcccatggcgatgttctcgaaggcgtccgtcagaccgtcgtacgccatggcgtcgatcatctggaccgcgccgtacttgtagccctcacgggacttcggcagcagatgcggggcgttggtcatggactcctgaccaccggcgacgacgacatcgaactcaccggcgcggatcagctggtccgcgagcgcgatcgcgtcgagcccggacagacacaccttgttgatcgtgagcgccgggacgctcatcggaatgcccgccttgaccgcggcctggcgtgccgggatctgccccgccccggcctgcagcacctggcccatgatcacgtactgcacctggtcgccgccgatccccgcacggtcgagggcggacttgatcgcgaagccgccgaggtcggctccggagaaggacttcagcgagccgagcaaacggcccatcggggtgcgtgcacccgcgacgatcaccgaggtcgtgctgttcgttccagacatgaggtgcgatccccttaccggcctgcacagccgaggagtgaacgagggtttacttgaatgtactgagcggtaggccacccgtcatccggcgtggagtgtgatcgcgcgcacgttgcgtaaccacctcccggagcgctgcactgactccatgctgacgcgaatcgaccacatcgggatcgcctgtttcgacctcgacaggaccgtcgagttctaccgggccacatacggcttcgaggtgttccactccgaggtcaacgaagagcagggcgtgcgcgaggccatgctcaagatcaacaacacggacgacgggggcgcttcctacctccagctcctggaacccacccgcgaggactccgccgtcgggaagtggctggcgaagaacggagagggcgttcaccacattgctttcggtacggcggatgtggacgcggacgccgccgacatcagggaaaagggcgtacgcgtcctgtatgacgagccccggcggggctccatggggtcccggatcacgttcctgcatccaaaggattgccacggagtactgacagaactggtcacttcggcggctgttgagtcacctgagcactgactcccgtacatatgggccggtagggttgggggcggtcgccgctcaaccagggcgaccggttcctgccttacggcgggaaccgggtcctgtccgagggcaggatcccaggccggggtccggtttcgggggacgagcgtcggggcagcagcccgtgctccgccgttgatctgacaccattccccgggggccccgttcggcggatggacggagctcgtttggagagacttgcgaccaggggacggatgggaccgcgcagtgcggggctacgaaagccaggagcgagagccggcggctgacgtcgaccatctcactcggttcgaggccgagatggatcggctcaagaccgagcgggaaaaggcgatccagcacgccgaggatctcggctaccaggtcgaggtactgcgcgccaagctgcacgaggcgcggcgcacgctcgcgtcccggcctgcttatgagagcgccgacctcggctatcaggccgagcagttgctccgtaacgcccagatccaggccgatcagctgcgcgccgacgccgagcgcgagctgagccaggcccgcgcgcagacgcagcggatccttcaggaacacgccgagcaggcggcccggctccaggcggagctgcacacggaggcggtcacccgccgccagcagctcgaccaggagctggccgagcgccggcagaccgtcgagtcgcacgtcaacgagaacgtggcgtgggccgagcagctgcgggcccgctccgagcagcaggcccgccggctcgtggaggagtcgcgggccgaggccgagcaggcgctggccgccgcccgcgccgaggccgagcggatcgccgccgaggcccggcagcggctcaacaccgacgccgagtcggcccgcgcggaggcggaggcgctgctgcgccgggcccgcacggacgccgagcggctgctgaacgccgcgtccacgcaggcccaggaggccacggaccacgccgagcagctgcgcagttccacggcgaccgagtcggacgccgcccgccggcaggcctccgagctgagccggaccgccgagcagcgcatgacggaggccgacgcggcgctgcgcgaggcgcgggccgaggccgacaaggtgctcaccgaggccaaggaagccgcggccaaggcgctggcgagcgcggagtcggccaacgagcagcgcacccgtaccgcgaaggagcaggtcgcccggctggtcagcgaggccaccaaggaggccgagaccaccaaggcctcggccgaggaagtggtcgcggacgccaaggccgaggcggagaagatcctcacggaggcggcggacaaggcccgcagcctgaccgccgaagagaccgcgtcccagctcaccaaggcggcccggacggccgaggacgtcctgaacaaggcgtccgaggaagccaagtcgaccaccaaggccgcgaccgaggaggccgagcgcatccgccgtgaggcggagaccgaggcggaccggctgcgcgccgaggcgcacgacatcgccgagcagctcaagggcacggcgaaggacgacaccaaggagtaccgcgccaagacggtcgagctccaggaggaggcgcgccggctgcgcggcgacgccgagcagctgcgcgccgacgcggtcgccgagggcgagcgcatccgctccgaggcccggcgtgaggccgtccagcagatcgaggaggcggccaagaccgccgaggagctgctggcgaaggcgaaggccgacgcggacgagctgcgtacggcggccacgaccgacagcgagaaggtccgcaccgaggccatcgagcgcgccacgacgctgcgccgccaggccgaagagaccctggagcgcacccggaacgaggcggagcggcaccgcgccgaggccgtcgagcagtccgaggcgatcaaggaggacgccgagcgggccgcccgtgagctgcgcgacgacagcgagcgcgccatagaggcccgccgggccgaggccgccgacgagctgacccggctgcacaccgaggccgagcagcggctcgcctcggccgagcaggcgctcagcgacgcccgcgcggaagccgagcgcatccgccgcgaggccgcggaggaggcggaccggctgcggaccgagtccgccgagcggattcgtacgctccaggcgcaggccgagaccgaggccgaccggctgcggacggaggccgcggcggacgcgtccacctcgcgggccgagggcgaggccatcgccgtacggctgcggtcggaggcggtggcggaggccgagcggctgaagtcggaggcgcaggacaccgccgaccgggtacgggcggaggcgcaggccgcggccgagcggctggcggccgagggcgcggagacgctggcggccgcccaggaggaggccacccggcgccgtcgcgaggccgaggaactcctcggctccgcgcgccaggaggccgaccaggagcgtcagcgggcccgcgagcagagcgaggaactcctcgccgtggcgcgcgcccgggtcgaggaggcacaggccgaggcggtccggctggtcgaggaggccgaccggcgcgcgacggagatggtcgcgaacgccgagcagaccgcgcagcaggtgcgggactcggtggccgggctgcacgaccaggcgcaggaggagatcgccgggctgcgcagtgccgccgagcacgcggcggaccgtacgcgcaccgaggcgcaggaggaggcgggccgggtccgcgccgacgcgtacgcggagcgggagcgggccaccgacgacgccaaccgcatccggcgggaggcggccgaggagacggacgccgccaaatccctcgcggagcgcacggtttcggaggcgatcgccgagtccgagcggctgcgttcggacgccgccgcgcacgcccagcgggtgcgcaccgaggcgtcggacgccatcgccaacgccgagcaggacgcttcccgtacccgcgcggaagcccgcgaggacgcgaaccgcatccgttcggacgcggccgaacaggcggacaccctcatcaccgaggtgacggcggaggcggagcggctcacggcggagaccaacgtcgaggccgagcgcgtacgggccgagtccgtggccaaggccgagaagctcatctcggacgcgaccggggacgcggagcggctgcgtgccgaggccgccgagacggtcggttccgcgcagcagcacgccgagcggatccgcagcgagtcccagcggctgaaggccgacgccgaggcggaggccgagcgggtgaccacggccgcgcgcgcggaggccgagcggacgctggacgaggcccgcaaggacgccaacaagcggcgctccgaagcggccgagcaggtcgacacgctcatcacggagacggccgccgaggcggacaagctgatctccgaggctcggcagaccgcgcagaagaccacggcggacgccgagggccaggccgacacgatggtgggtgtcgctcggaacgaggcggagcggctggtctcggaggcgacggtcgagggcaactcccgggtggagcgggcccgtacggacgcggacgagctgctcgtcggcgcccgccgggacgcgaccgcgatcagggagcgcgcggaggagctgcgcgaccgcatcacgagcgagatcgaggagctgcacgagcgggcgcggcgcgagtcggccgagacgatgaagtcggcgggcgagcggtgcgacgcgctggtgaaggccgccgagggccagctcgccgaggcggaggcgaaggcgaaggacctggtcgcggaggccaattccgaggcgagcaaggtacgcatcgccgccgtgaagaaggccgaggggctcctcaaggaggccgagcagaagaaggccagcctcatctcggaggccgagcagatcaaggtcgaggcgatccgtgaggcgcgggccgccgtcgaggagggcaagcgggagctggaggtcctggtgcgccggcgcgaggacatcaatgcggagatctcccgtgtccaggacgtcctggaagcgttggagtcttttgaggccccgtccggcggcaaggacggaggcgtcaaggcgggtgccgcagcgggcgcgactcgttcgggtggcaaggtgtcagaaggctagccagaggtgtcgattctgtgcttgccgggaggtttaacacagctcctggcaagcgctccgacagttagccacccaaaaggagtgtcattctccagatcaaacacgcatccgctcgatgacacgccgctttgacccctaggattccttctatcacctcaccggtctcattcgacaggaaccccatgagcgacacttccccctacggcttcgagcttgtccggcgtgggtacgaccgcgctcaggtggacgaacgcatctcgaagctcgtctccgaccgtgacagcgctctggcccgtatcactgctctggaaaagcgcattgaggaactccacctcgaaacgcagaacgcccaggcccaggtcaccgacgccgagccgtcgtacgcgggtctcggcgcgcgcgtcgagaagatcctccgcctcgccgaggaggaggcgaaggacctgcgcgaggaggcccgtcgcgcttcggagcagcaccgtgagctcgccgagtcggcggcccagcaggtgcgcaacgacgcagaatcgttcgctgcggaccgcaagtccaaggcggaggacgagggcgtccggatcgtcgagaaggccaagagcgacgcctcccagctgcgccaggaggcgcagaaggacgcgcagtcgaagcgggaggaggcggacgccctcttcgaggagacccgcgccaaggccgcgcaggccgccgccgacttcgagacgaacctggccaagcgccgcgagcagtccgagcgcgacctggcctcgcgtcaggccaaggccgagaagcgtctcgcggagatcgagcaccgcgcggagcagctgcgcctggaggccgagaagctgcgtacggacgccgagcgccgcgcccgccagacggtggagacggctcagcgccaggccgaggacatcgtggccgacgcgaacgccaaggccgaccgcatccgctcggaatccgagcgcgagctggccgccctcaccaaccgccgcgactcgatcaacgcgcagctcacgaacgtccgcgagatgctcgcgacactcacgggcgcggcggtggccgcggccggcacgccgtcgaccgacgacgagccgatctcgcgcggggttccggcccagcagtcccggtaacacctgagcaccgcgctcatcgagcgcaccggcacagccccccgccactccggtggcagggggctttgtcccgttctagcgtgagcgcatgatcgagctggacgggctgaccaagcggtacggcgagaagttggcggtcgacgacctcaccttctccgtcgagccgggcatcgtgacgggcttcctcggccccaacggtgccgggaagtccaccaccatgcgcatgatgctcgggctcgaccgtcccaccgcgggtgacgtcctgatcgacgggcggcattacgaccgtctcaagaacccgctcaagtacatcggcgccctgctggacgccaaggcgatgcacggcgggcgcagcgccttcaaccacctgctgtgcctcgcgcagagcaacggcatccccaaggcgcgggtgcacgaggtcctcgacatggtcgggctgaccgcggtcgcgaagaagaaggcgaagggcttctccttcggcatggggcagcggctcggcatcgcgggtgcgctgctcggcgatccgcggatcctgatgttcgacgagcccgtcaacggtctcgaccccgagggcatccactggatccgcaacctgatgaaatcgctggcctcgcagggccgtacggtcttcgtctcgtcccatctgatgagcgagatggcgctgaccgccgaccatctcgtcgtgatcggccagggccggctgctcgccgacacgtccatggccgacttcatccagcagaactcgcggtcgtacgtccggatccgttctcctcagcgcgagcggctcctcgacgtgctgcacggggcggggatcacggtcgtcgagaccggcggcggcacgctggaggtggacggcggcaagtccgagctcatcggcgagctggccgccgggcaccagatcgtgctgcacgagctgagcccccagcaggcttccctggaagaggcgttcatgcggctgaccgcggagtcggtggagtaccacgcgcatccgcagggcccgccccaggactggggcgacgcctggaagaaaggggcctgaacatgtccgcggcgcaggtcgtccgctccgagtggaccaagatccggtcggtggcgtccacggtgtggacgctctccctcgccgtggtcgtcaccatcgccctcggcatgctgatctcggccctggccgggaacgagttcgacaagatggacccgcgggacaggctctccttcgaccccacgttcatcagtttcgccgggatgagcctcggccagctcgcgatgatcgtgttcggggtgctcgtcgtgtcgaacgagtacagcacgggcatgatccgcagctcgctcgccgcggtcccccagcgcggcacgttcctgttcagcaagatcgcggtggcggcgggactcgccctcgtcgtcggcatcgtcaccagcttcgccgcgttcttcctcgggcaggcgatgctcggctcccaccgggcgtcgatcagcgacacgggagtgctgcgcgcggtcatcggcggcggcctctacatgacgctcatcgccatgttctcgatgggtgtggccgcgatgctgcgctcgccgatgctgtcgctgggcatcctgatgccgttcttcttcctgatctccaacgtcctgggcaatgtctccgccacgaagaagatcggccgattcctgcccgaccaggccggcagcaagatcatgcaggtcgtgacgcccctcggcgacgacactccgtacggtccctggggcgggctcgggatcatggtgctgtgggtggtgctggcgctcgccgggggctatgcgctgctcaagagacgggacgcgtgagcggcctgaggccgctcggacccaccctgaccaggcacgacccgtacctgacaaagacacacctctgtgacctgcggatttttacatcctcttgagtggaaccgtcagcgccccgctatcctcctaacccttacgggggcgtgcgccccgacgtcctgaacctttcgatgggtgcggagaatgatcgaggcagtcggcctgacgaagcgctacggcgacaagacagccgtgtacaacctttccttccaggtgcgaccgggctccgtcaccggcttcctcgggcccaacggctcgggcaagtccacgaccatgcggatgatcctcggcctggacaaccccacctccggtcaggtgacgatcggcggctacccgtaccgcaggctgcccaacgccccccggcaggtcggtgcgctcctcgacgccaaggccgtgcacggcggccggcacgcccgcaaccacctgctctccctggcccagctgtccggcatcccggcccgccgggtggacgaggtgctcggcgtggtcggcctccaggacgtggcccgcaggcgctccaagggcttctccctcggcatgggccagcggctcggcatcgccgccgcgctcctcggcgacccccaggtgctgctcttcgacgagccggtcaacggtctcgaccccgagggcatcctctgggtgcgcaatctgatgaagtccctcgcggcggagggccgtacggtcttcgtctcctcgcacctgatgagcgagatggcgctgaccgccgaccacctgatcgtgatcggccgcgggcagctgctggccgacatgagcatccgcgacttcatctcggccaactccgccgacttcgcgcgcgtccgcactcccgagaccgacccgcagcagcgcgagaagctgacggccgcgctgacggaggcgggcggacatgtgctgcccgagctggacggcgcgctgcgcgtgaccgggctgccgctgccgcgcatcagcgacctcgcgcactcctccgacgtacgcctgtgggagctgtcgccgcatcaggcgtcgctggaggaggcgtacatgcggatgacgcagggcgccgtcgactaccgctccacgatcgacgagaaggccggtctccagcagccgctgccgccgggcgtgcagccgccgatgcccgtgccggggcagggccagccgggctggtacgccccgccgtcgccccagcagggcgggcagccgttcgcgatgccgcaggggcagccgctgccgcagggccaggccgcggcgggcccgtacggcgctccgtacggcgccccggccgcgcccgccgcacaggcgccgggcggccccaacccgtacgcgcagcccgcagcctcaggccccggtccagcccgcccaggcgcccgtggctcccgcggtccctgcggcctcggccgtgccccccagcgcccgctcaggcccccgcgcagccgagcgccgcacccgcacagcccgtcgcggcccccgccgcgccctccgccgctcccgacctgaacaagcgcgacagcgaggacaaccgatgagcacgccccagcccccgatgccgcagccggccgcgcccgcccccacctggcaggcggcgtccggtggttcgtacacctcgccgatcccgatcatccgcacccacctcgggcatgcgctcgcctccgagtggacgaagatcaagtcggtccgctccacgatctggacgctgggcgtcttcctgttcctcgtgatcggcatcggtctgggcgccggcgccctcgtctccggttccgacacggacatgcacggtgattcgccgctggcgctgggcttcttcggtctgctgctcggcagcatctgcatcatcacgctcggcgtgctcaccaccgcctccgagtacggcaccggaatgatccggaccacgatggtcgcctgccccacccgctcccgggtgctgctggcgaagtccgtcgtgttcttcgccgtcgcgttcgtggtcaccacggtgagcgcctcgttcgtcgccttcgcgcagtcggcgatgctggagggcagcggtgcgggcacgcccagcggcggggagtggctgaagggcacggtcggcgtcggcctctacgtcgcgctgctcgggctgctctcgctgatcgtcggctccatcatccggcactcggcgggtgccatcaccatcatgatcggcgtcctgctcgccccgctggtcatcgcgatgttcatgttcgcggactcgctgcgggacctccagcaggccctgttcgagtactcgatcccgaaccagctcgcggtcttctacgacaactcgctcagcgggtcggggccgtccggctgggacccgctgtggatcatgctgggcgtgacggccgtcgcgttcggcggcgcgtacctcctgctggagaagcgggacgtgtaggccccctgggaacgaacgctcgaacccggtcagaacctgggcgcgttacgggaccgctgcacccgcagggtgcggcggtccttcgcgttccagcacgccttgtgccagtggcgccggtcgtccacgcccgcgtgctcgggccaggccaccacatgcgggacgccggaggggatcatctggtcgcagccggggcagcggtaggtcttgccctccgcgctggcgcccgcgacgtggcgcacgctccactcctcgccctgccagctctccgtggactgccagccgccgtagcggccggagcgctcctccgccgcgctcccgccggacgagccggcacccttcggacggttgcgacgcggggacacaggacacctcacggagctatacagggagcacgggcggcatccagcctacgcgccgcctcctggggtactcctcctccaccgaccggcacagaccgccctcccgtcggcgcattctgcagacaatccgcaaatctctccgccaagccgtgtcttcggcacatgtcaggcagttatgccgggtggggagctccgtgtcggagccaaggaagcaggaagtgccatgcacgtaggaagttttgtactggcggcccagttcccggggcagggccagggggaggcgctgcaccgcgcggtgcggtcggccgaggtggccgaggaggcgggtctcgacacggtgtggttgggcgagcaccacttcgtgccgtacgggacgtgcccgtcggcgatcaccctcgcggctctgctgctcggccgcacccggcggatccgggtcggcacggcggtcagcgtgctgcccaccgtccacccggtggcgctgggcgagcaggccgcgctgctgcacctcacctccggcgggcggttctcgctgggcgtgggacgcggcggaccctgggtggatctggaggtcttcggttcgggtctcgaggcgtacgagaaggggttcccggaatcactcgatctgctggtgcgctggttgcgcgagccgtccgtcgcgggcacgggggaacgattcaccttccgtgaagtcccggtcgtcccccggccgtcggagtcgctgacggacgcctcggggcccgaggtcgtcgtcgcctgcacctcgccggccagcgtccggctcgcggccgagcgggggctgccgatgctgctcgggatgcacgtcggggacgaggagaaggccggaatggtcgcactgtggcggcagcacgcgcgcgccagcgggctcggcgcgggcgagatcgcgggtgccgcccatgtctcggcgggcatctgccagatcgccgaccggcgcaccgacgccgtcgagacgctgaccaaggcgatgccgggctggctgcggcaggggctcgacgcccatgtgacggtggacggtcggccccgcgcgatgcgggacccgctggcgtacaccgaactgctctgcggactgcacccggtgggcagcccccggctgtgcgccgaccggctggcggcgacctcggagcggaccggcatctcccgcttcgcgctgctcgtcgagggctcgggcgacctcgcggccaccgaggagaacgtacgccggctcggcaccgaggtacttccccacctcggctgagcgagcccgccaagtggcgcgccccgaggggagcttgccgccccgtacagatgcacctcccgcatacggagcggcaagccgtgcgccatcgccgggtcagcagtccctgaactccggggactggttcagcaactggctgcggaccgaggtgaagcgtgccagcttctggtccaccgaggtgtccagcgggaacaccgcaacccggtggcagttctggaaggccagtcgcactccgaagtgccgctgaagcgcgccgcgtatcgcgtcactcgcgagcgcacgcagcagctggccacgcgcctgctcgtccggcgggggcgtctggttgtcggcgaacgcgccgccgtccaccttcagctgggccaccagggagctgatcatctcccatgcgtagggcagggaggtccggacgcagtcgacgaagtcagcttcgtcgacctcgcctcgctcggcctgttcgagtagggccggtgagacgtcgagcgacatgggttctcctctcggaccccctgtggagcgggggctgacggacagggagggagttcgcgatttcgaacacgctgcgtacgcgcgtcgcgacctcccgtttatacggtaagcaacggacggtgacggcaccaggagaatgcgaacacagagaactctcaatgggcacacaatcggccacgaccgaacaggcgtcttccagggcgaatcgcgtgcaccactgcccgtcgagtagcgttgccgaccatgcgtctcgtcattgcccgctgttccgtggactacgcgggccggctcaccgcccatctcccgtccgccccccgtctcatcctggtgaaggcggacggcagcgtctcgatccatgcggacgaccgggcctacaagcccctcaactggatgtcgccgccctgcacgctgaaggaggggtcgggggacgaagagggcgtctggaccgtcatcaacaaggcgggcgagaagctcatcatcacgatggaggaaatcctccacgactcctcgcacgaactcggcgtggaccccggcctgatcaaggacggcgtggaagcgcacctccaggaactgctcgccgaccgcatcgagacgctcggcgacggctacacgctgatccgccgcgagtacatgaccgccatcggcccggtcgacatcctgtgccgggacgccaccgggcagaccgtcgcggtggagatcaagcggcgtggcgagatcgacggcgtggagcagctcacccgctatctggagctgctgaaccgcgacccgcacctcgcgccggtgcgcggcgtcttcgccgcacaggagatcaagccgcaggcccgcgtgctggccacggaccgcggcatcggctgcacggtcctcgactacaacgccatgcgcggcatcgaggacgacaagctccggctgttctgagcactccggtacgagtcaggttcaagtccggtacgcctcacctacgaccgagggccgagtccgaaagcggacccggccctcttgtattcggtacgtggattccgtacgcgactgtcgtgcgcggccgtcagatcaccgggtccgagtcgctgggcgacccggcgccgctgctctgcggtgcgctcgccgtaccgctgccggtggcgggagcactggaggacgccgggccgctggccgaatccgtcgtcgacggggccgtcgtagtcggcggcggtgtggtggtcgccggaggcgtgctggtcggcggggtcgtcgtcgggttgctggtcgtcggcttggacgacgtcggcggcttggtcgtcggcgacttcgagggcgacttggacggcgacgtcgacggggtggtccccttcgttccggtcgggtcgtccgagggccgggcgctggccgacggggccgggtcgtccgccgtcccgtaggtgccgtcgggacccgggtccgtgggcacgcctgcgacgcccgagtcgccggtgtccttcctcggcttgtccgcaccgaggctgtcgtcgtcgatgccctggctggccgacgggttgacgccgaccttctcggccggcgggtcgtcgttgttgttggacgtcatgccgagcgtgacgacggtgccgagcacccccgccagcagcacaccggcgcccgcggccaccaggttgcgccgggcgccgccgacgatgcccttgacggagaccgggccctgccgggcgggcgtgggctcggtccggtgggtgaccagggtcgtaccgtcgccggacggctcgggcagtccgaagccggccggtaccccgccgggcggcgacgccgactcctcgtagcgcgcgtccggcacctcctcgcccgccgccgtgcgcccgccgggcagtgccgccccggagcggtcggcgaccagggcgagggcgcggcggccggcgaccgtgccgcgcttgtcggcgagggcgccgcgcagcccgatggaggcctccagctcggcgcgggcccggtcgagctggccgcagcagagcgcgaggatgcccagttcgtggtggaagtaggtctggtcgccgacctcgccggcgagccgggacgcctcggcgccggcgcgcagcgcgcgctcccaggcgctccagtgcagccccgcggcgaacgcgggggtggcgtggcgggccagcagtacggcggcgctctcctcgttctcgcccgggggcgtggtgagcggcaccaggacggtgagcgcggcgagcacggcgtcggcctcggccgagacgcgctccggggtcaccgaggggtgcccggcccaccaggcgtagtgctgggcggcggcgagggcgcgggcgtcggccccggtcgcgtatccggcggcctccagctgggcctgcacaccggccgcgagccggtagcgggagccgaccggcgagacgagcgcacagctcaggagctcggcgagcgcggcgtcggcgtgggtgtcgtccacgagggcgggcagatgcgtctggtgcggcacctcgccgccgagcgcgacggcgaacttgagggtctcgcgggccgacgcgctcagccgcgaggcgagcagtgaggcgggcgcggcaccctcggcgagggacggcaggggcaggtcgtgaccgtcttcggcgtccgacggcgcgtcgggggtgtctcccggttcgagcgaggccgagagcctcggggacggcgcgtcgtcgtagaagccgagcgagtcgaaggcgttcgggtcggcgcgcagctcgtcgcgctgccgcagcagcgctccggcctgcatgaagcgcaggggaagaccctcggactcgaaccagaggtcgcccgcccagttcgactcgtcctcggtgaggacccggccgaccgcgcgctcgaggagttcgaggccgcccgcgcggtcgaggccgccgaggaagacctcttcgagcagggagtcggcggagggcgccggtacatcgggcgtggccgagatcaggaaggcgcactcgggcgtggcgtcgagcagctcgtcgagcgcgctgccgccgaactccacgtcgtccaggacgacgaccgcgccgatctcgtggacgagccggagcagttcctcccgctccggccggtggagatcgctcttgtaaacggcggcgaagaggtcgtggaggaggtcgctcgcggtgcgccggtagccggtgaggcggacgacgccgtcgggggcgaggtccgcgcagtcctcggccacggcgtccagcaggacggtgcggccggagccggcggggccggtgaggcggacggagcggccgcgcgcgaggagccgtacgagccgctcgcgctcctcctggcgctccaggagcggcagccggggccgcgccggtccgggcgggacgggcggctgggcggcgcgggcggtctcggcgcgctcggccggagcgaacttcaccggccggggtggccgctcgcccggcgggcaggcctctatctcgctgccgtcgacggggttgacggtgagcaggtagtcgcccgagacgagctggacggtgcgggcgaccaccggcgtgtgctgtccgaagtctgaggtgagggagtcccgcggcgggcgctggcgcggcgtttcgccgtcaccgtcatggccgtactcctcgggttcctggttgttcgggtccataggtccaagccccccaaaagcgtcgtgtgcgggttctgtcttcggtctcccgtcgtccgccccaagggtgggccgcgcggcgtccggcgcgtgcgatcgcaaagcgccggaaggtcctcgtagcggagctaccagggcctttcggcaacgccgcgagcgtgcgtgccaggcgtcgcgcggcagacgggagtccggagacaggacccgagcccctcccggccttgctgcacaccgcgctgtcgcttctggtccggtgcccgctcgagggtttccggcggcgggcagccgaaccctaaacctttgcacagtatctcggaacagtcggggtaccgggccgtccgagacgtcacagcttcgtgaggattggtgcgcggcgtacgtttcaccccccggtggggtggtgtcacacccggggcagtgactcgaccccgatgccgccctcgatcgccaggatccggtgcagccgggtggccaccagcaggcgctgcatctgcggtggtacgtcgcgcagcacgagccgtctgccgcagcgtccggcccgccggtgggctcccatgatcaccccgagtccggtggcgtcccatgagtccagttcggacaggtcgagaatcaggtcaccgactccgtcgtcgacggccgagtgcaggaccgttcgggcgtccgccgcgctgcggacgtcgaggcggcccccgacgaccagctcggcgtggtcgcccctgatatgcatatgcgctccccgagagtgcgttggcgtgctccgcgacagtggttgtgcaacgtctgactgccccaatggcggtcaggttgccgtctgtaagcgaaccgataccgaattcactccatggagtgaggccccagggggcgcgcccggttcagtgcttgtagaagccctgcccgctcttgcgtccgatgtcaccggcgtcaaccatccggcgcatcagctccggcggggcgaacttctcgtcctgggactcggtgtagatgttgctggtggcgtgcagcaggatgtcgacgccggtgaggtcggcggtggcgagggggcccatggcgtgaccgaagcccagcttgcaggcgaggtcgatgtcctcggcggtggccacgcccgattcgtacagcttcgccgcctcgacgacgagcgccgagatgagacgggtcgtcacaaaaccggcgacatcgcggttgacgacgatgcaggtcttgccgacggactcggcgaactcccgcgtggtggcgagggcctcgtcgctcgtcttgtagccgcggaccagctcgcacagctgcatcatcgggaccggcgagaagaagtgcgcgccgacgacgcgctccgggcgctccgtcaccgcggcgatcttggtgatcgggatggcggaggtgttggaggcgagcacggtctcgtcccgcacgatcttgtcgagcgcgcggaagatctcgtgcttgacctccagcttctcgaagacggcctcgacgacgatgtcggcgtcggcgaccgcgtccagatcggtggtcgtggtgatgcgcgcgagggcggccccggcgtcgtcggccgacagcctgcccttgctgacgaacttgtcgtacgaggccttgatgccgtcggtgccgcgggtcagcgcctcgtcggtgacgtcgcgcaggacgacgtcccagccggcctgggcggagacctgggcgataccggaacccatgagtccggctccgatgacggcgagcttccctgtcactccgactccccttagcacgctgtttatgttgcctctccggcggaccttagcggtcgtgagggcctgtgcgaacggggaagagacgcgtgtcacgtctcacggcatgagacacctgtcacttgacgatccggcacggggacgcgtcccgccggcaccgcgccgacggctcagcccgcctcccgcacggcatagttgagcaccctctcgctgaacagctcctccatgtcgtcgagtagaccgagggcctcacgggagacctcgccgggggagcggccggccatcatctcgcgcccgatgagcgccagcagcgtggtgtgcgcccagccgatctgaccggccatcagcgacggcatcgggtcgtccggatcggcgccggtctccgtacgcagggtctcctcgaggagttcgaggctctgctggttcatgtgccccagacgggcgcggagtccggccgccgcctcgacgactttcataaagcggtcatatccctcgaagaggcccacctggggcgagaccgcctccacctcgccgcgcagctcgcgcagtaccgcggcggccgcggactcgcccgtgtcgcgggcgcgcacaaaacgcgagaggcgcgcgacgctgcccttggcccggtcgaggaagaggtcctccttggcctggaagtagttgtagacggtgttgacggagacgtcggccgcctcggcgatctcggcgatcgtcacctcgtcgaacccgcgctccaggaacagccccgtggccacatccgagatgtgctgcctggcctgccgcttcttccgctccctgagcccctctgccatgcccccatcgtagctttgctgggtccgctgaaattttggtgtcattgcaaaattgcagggactctgtttttcttgacggcatggcaatcatcagtacggccggtctggcccgtaccttccggacgaaacgcggcccggtcgaggcggtgcgcggcatcgacctcaccgtgcggccgggcgagatcctcggcttcctcggcccgaacggagccgggaagaccacgaccctgcgcatgctcacgaccctgctgccgcccaccggcggtgcggccaccgtggccggctgcgacctggtctcggaccccgtcggagtgcgccgggccgtggggtacgtggcgcagtccggcggtgtcgacccgaatgtcaccgcgcgggaggagctggtcacgcagggacggctgtaccgcctgaccaggctccaggcgtcggagcgcgccgcggaactggcgcgtgacctggatctggcggacctgctggaccgccggacggcggcgctctccggcggccagcggcggcgcctcgacatcgcgatggggctcacgcaccgcccccgggtcctgttcctcgacgaaccgacgacggggctcgaccccggcagccgggccgacctctgggacctggtccgccgtctgcgcgacgagcacggcaccacggtcttcctgaccacgcactacctcgacgaggcggacgcgctctccgaccggctcgtgatcgtcgacaagggcgtcgtggtggccgagggcacgccgagcgcgctgaagctggcgcacggcggctcgatcgacgcgacgctccaggacacgttcctcgccatcaccggccggggcccctcgcccgccgactccgcccccgtagccgtatagacatccgcacccgtagccgctgaggaacccgatgctcttccaggacaccgcgctgatctacgggcgctacgcccgccagaccctgcactccaagttccagatcttcttcggcatgctgatgccgctgctctacctgctgctgttcggaccgctcctgacccatctgccgctgggatcgcacggcagttcctggcaggtgctggtgcccggcctgctgcttcaactcggcctgttcggctccctgttctcgggcttctcgatcatcttcgagaagaactacggcgtcgtggagcggatgcgcgtcacccccgtcagccgtctcgccctgctcctcggccgggtactgcgcgacgccaccctgctggtcttccaggcagtgctgctggtgctcaccgcgctgctcatggggctgcgggcgccgctcgccgggatgctcatcgggttcgcgttcgtcgcgctgctggccgtctccctcagctccctgtcgtacgcggtggcgctgaaggtcgaccggccgcaggagttcggcccgatcatcaacgcggtctccctgccgtcgatgctgctgtcgggcctgatgctgcccatgaccctcgggcccgactggctcgacgtcctgtcccacgtcatgccgctgcgctatctggtggacgcgatccgggacgcgtacctcggccagtacgcgacctcggccatgctgtacggcgtcctggtcgccctcggcttcgcgacgctcgccgtgacggtgggcacacgggtgttccggacggccggagcgtaactacgctggtcgcatggtcaatctgacgcgcatctacacgaggaccggcgaccagggcacgaccgccctcggcgacatgagccgggtcgccaagaccgatccccggatctccgcctacgccgacgccaacgaggccaacgccgccatcggtacggcgatcgcgctcggcgggctcgacgaggagatcgtcaaggtcctcgtccgggtgcagaacgacctgttcgacgtgggcgcggacctgtcgacgccggtcgtcgagaacccgcagttcccgccgctgcgcgtcgagcagttctacatcgacaagctggaggcggactgcgacctcttcaacggcgagctggagaaactgcgctccttcatcctgcccggcggcacgcccggcgcggcactgctgcaccaggcgtgcacggtcgtacgacgggcggagcgctcgacgtgggccgcgctggaggtccacggagaagacatgaacccgctcaccgcgacctacctcaaccggctgtcggacctgctcttcatccttgcccgcaccgccaacaagggcgtcggggacgtgttgtgggtgccgggcggagagcgctagcggagcttggcccgtttttgcttcgggaacagcgtgtagctgagggcgatgatcacgttgatgccgatcagccacaccatcctcatctgccacatgcgcagtgagtcggtctcgccgccggaaccgacgtaccagatcgcggcctgaagcagcgccgtcgcgacgacggccgcgaggatccagcgccccgccacccgccactcgtggacggcgcgggccaccccgtacttcggcggcctgaccggcggtggcccgcccgcgaaccggtgggccacccgggcgtcggcccacttgatcgtggagtggcccaggcccacggtgaagccgatgtagacggcggcgagaccgtgcttccagtcgggctccgcgccgttcctcaggtcgatcgcggtgacagcgaacaggacgacttcgagcagcggctcgcacagcaacagggccaggccggtgcgcggcatcctgaacgcgtagcggaaggtcagtcccgcggccagcagcacccagaaggccacttcacaggcaatgacgagtgtgacgatcacggctcgctcctctcggtcacccttccagactcccggcggcgcggacccggatcgtcgtcgccagtgaggaaacggcactgcatccttcgatgtagcggcggaccgtcccccaggatcaggcgacacgcgggtgcgccgtgttggatggactcatggccgtacgactcccccgcccccaccaccacgacgtgcgcatcgcggtgggcgggctcctcggggggctgctgctgtgggggctcggcctcagtccacggaacccgcacgacagtgtcgtgctgtggccggcgcactgggcggtgctggtcccgctcgtcgtgacggccggctgcgagctgctgcgcaggacccggccgcgggcggccctgctgatcggcacggccgccgtggtcgccgacacggtgaccctgggcagcgtggtcaccgtcgtgatgttcacggacctcatgtacgcggccgtcctgtacggcacccccgcctccgcccgccggctgccctggctcaccgggctgctcaccgtgatcggcggggtggggccggccgccgtctggggcgaccccgacggcctgctgatcggtgtcggcgtcggcgtggtggcattcgcgcccgccgccaccggctcggtcgtccgcaaccaccgcgaggccgccgaggccgcccggctgcgcgccgaacagaccgccctgctcgccgagatggaccgctcccaggcggtcaccgccgaacgcgccaggatggctcgggagttgcacgacatggtcgccaaccacctgtcggcgatcgccatccactccaccgccgcgctgtccatcgacgagccggggacctcccgggaggcgctcggcgtcatccgggagaacagcgtggcgggactcgccgagatgcggcggctgatcgggatcctgcgcgacggcgacggcgagggggagccggtcgcgaccccgaccctcgacgggctcgccgcgctcgtcgacggcgcccggaccaacggcctcgacgtcaccctcgacgccgaccccggccgggttcccgccccggtcgagctcgccgcctaccgcatcgtccaggagtccctgaccaacgccctcaagcacgcctcccccggccgggtcgccgtcacgctcgccgcgcgggacggctccctcgccgtgcgggtgaccagcccctacggcgaccgggacgggccgcgcgcgcccggctcgggggccggcctggtcgggatgcgggaacgcgtcgccctgctgcacggaacgttcgaggcgggccccgagaactccggccggggcacggtctggaccgtacgcgccacccttccgatcacccatggaggaaccgaatgatccgcgtgctcgtcgccgaggaccagtccgccgtacgggccgggctcgtcctcatcctgcgcagcgcgcccgacatcgacgtggtcggcgaggccgcggacggcgagcaggcggtcgcgctcgcccgtgaactccggccggatctcgtcctcatggacgtgcagatgccgcgtctcgacggggtgtccgccacccgccgggtcgtcgccgagaacctggccgacgtactggtcctcaccaccttcgacctcgacgagtacgtcttcggggcgctgcgcgcgggcgcctgcgggttcctgctgaagaacaccgaggcgcgccagctgctggaggcggtccgcaccgtcgcgcggggcgaggggctgatctcgcccgcggtcacccgccggctgatcgccgagttcgccgcgaagcccgtacgggagccggggcccgacccggtgatcctcgacgtcctcacccggcgggagcgcgaggtcctgtcctgcctcggccgggggatgtccaacgcggagatcgcggcccggctcgacatggcggaggcgaccgtgaagacgcacgtcagccgcctgctggggaagctggagctgcgcagccgggtccaagccgccgtgctcgcgcaggagttgggggtctgaggcagagcccgtgcgcactggtccagacctattgacctatggtccagacctttctattctcgccgcactgcgcttgcgctcagtcatgaccacgacacccccgggcgcgccgaaggtcaacatcagaagaggaggcgcagcatgcgcttcggacacagagccgtggcagggttcgccaccctgctgctcccgctcgccggcctggtggggctcgcaagccccgcccaggccgcaggctcggccaccgccacctacgccaagacccaggactggggcaccggcttcgaaggcaagtggaccgtcaagaacaccggcaccagcagcatcagttcctggacggtcgagtgggacttcccctccggtacgtccgtgacctcggcctgggacgcggacgtcaccagctccggcacccactggaccgccaagaacaagtcctggaacggcaccctcgcccccggcgcctccgtctccttcggcttcaacggcgcgggctccggatccccttccaactgcaagctgaacggcgacagttgcgacggcgccaccacccccggcgacgccgctccctccgcaccgggcaccccgaccgcctccggcatcaccgacacctcggcgaagctgtcctggacggcggccacggacgacaagggcgtcaagaactacgacgtcctgcgcgacggcgccaaggtcgccaccgtgacgacgacctcgtacacggacaccggtctgaccgccggcaccgactactcgtacaccgtccaggcccgtgacaccgccgaccagaccggcccggtcagcggcgcggtcgccgtgcacaccaccggcggcggcacgactcccccgcccaccggctccgccgtcaagctcggctacttcaccgagtggggcatctacggccgcaactacaacgtcaagaacctggtgacgtccggctccgcgtcgaagatcacgcacatcaactacgccttcggcaacgtcaccggcggcaagtgcgcgatcggcgactcctacgccgactacgacaaggccttcaccgccgaccagtcggtcagcggcgtcgccgacacctgggaccagccgctgcgcggcaacttcaaccagctgcgccagctgaaggccaagtacccgaacatcaaggtgctgtggtcgttcggcggctggacctggtccggcggtttcggcgcggcggcggcgaacccggccgcgttcgcccagtcctgctacgacctcgtcgaggacccgcgctgggccgacgtcttcgacggcatcgacatcgactgggagtacccgaacgcctgcggtctctcctgcgacaccagcggctcggcggcctacaagaacctgatgtcggcgctgcgcgcgaagttcggttcgaacaacctggtcaccgcggccaccaccgccgacggctcctccggcggcaagatcgacgcggccgactacgcgggcgccgcccagtacgtcgactggtacaacgtgatgacgtacgacttcttcggcgcctgggacgcccagggccccaccgccccgcactcgccgctcacctcgtacagcggcatcccgaaggccggcttcaccacggccgacgcgatggccaagttcaaggcgaagggcgtgcccgcgagcaagctgctgatcggcatcggcttctacggccgcggctggacgggcgtcacccaggacgctccgggcggcacggccacgggcccggcggcgggaacgtacgagcagggcatcgaggactacaaggtcctcaagacgtcctgcccggccaccggcacgatcgccggtacggcctacgcgcactgcggcagcaactggtggtcctacgacaccccggcgaccatcggtacgaagatggcgtgggccaagagccagggcctgggcggcgcgttcttctgggagttcagcggtgacaccggcaatggcgagctggtgagcgccatcaacagcggactcggataaccctcacgccacgttgacgctcccccagactccgtccgggggggaccccacccagcgagtgaatgtggcctttcaggccacattcactcgctgtccgggcggggctgcctccagccacgcgagaaatccggtcagcgcgtcttcgctcatcgcgagctcgagacgcgtgccccggtggagacagacaaggatcacggcgtcggagagcagcgccagctcctcctcgccctcgggggcgcggcggccggccacctcgatcgccgagcgttccaggacgcggcgcgggcggggggcgtaggagaagacgcggtaccactcgatgcggtcgccgttgtagcgggcgacgccgtagctccagcccttgccgttcgagtcgcccttctcggggacgtcccagcgcagactgcagtcgaacgttccgccggagcgctggatcagccggcggcggagaccgaagacgaagagccccaccactacgagcgccactaccaacccgcacacagtcagagcgaggaccatcgacaccgacctcctcgtctcctaggtaaaacaggtaacggaacggaaaaaagcacccgcatcgcctcagccgcggcccggtctggattgctccagtcccggccgcggctgagtcacgtcatgacgtgcgcgctggggtcagcgcgccgacaccgcacgcagtcggacgtccgcgcgacgctcggcggtggcatcaccctccgccttcgcccgctcgagctcccgctccgcgcgctgggcatcgatctcgtccgcaagctcggcgatctcggccagcagcgacagcttgttgtcggcgaacgagatgaaaccgccgtgcaccgcggcgacgaccgtttcaccatcactcgtacgaatggtcaccgggcccgattccagcacaccgagcagcggctggtgaccgggcatgacgccgatgtcgccggacgtggtgcgcgccacgaccagggtggcctcgccggaccagacctggcggtcggcggcgaccagctcgacgtgcagctcagcagccaaggtggctcctcgggtcaccacccggcgggtctgccgggtgttgggtcaaattctagtaggcgtacatgagggggtgggacgcacccaccccctcatggtgagcacggggctcaggagacgccgagctccttggcgttggccttgaggtcctcaatgccaccgcacatgaagaacgcctgctccgggaagtggtcgtactcgccgtcgatgatcgcgttgaacgcggtgatcgactcgtccagcgggacgtccgacccgtcgacgccggtgaactgcttggcgacgtgggtgttctgggacaggaagcgctccacgcgacgggcgcggtggacaacgagcttgtcctcctcgccgagctcgtcgataccgaggatcgcgatgatgtcctggaggtccttgtacttctgcagaaccgtcttgacgcgcatggcggcgtcgtagtggtcctgcgcgatgtagcgcgggtccaggatgcgggacgtggagtccagcgggtccacggccgggtagatgcccttctcggagatcggacgggagagaaccgtcgtcgcgtcgaggtgggcgaacgtggtggccggggccgggtcggtcaggtcgtccgcggggacgtagatcgcctgcatcgaggtgatcgagtgaccacgggtcgaggtgatgcgctcctggaggagacccatctcgtcggccaggttcggctggtagcccaccgcggagggcatacggccgagcagggtcgacacctcggaaccggcctgggtgaagcggaagatgttgtcgatgaagaacagcacgtcctgcttctgcacatcgcggaagtactccgccatggtcagaccggccagggccacgcgcagacgggtgcccgggggctcgtccatctggccgaagaccagggcggtcttgtcgatgacgcccgagtccgacatctcctcgatgaggtcgttgccctcacgggtgcgctcaccgacaccggcgaacacggagacaccgtcgtggttgttggcgacgcggtagatcatctcctggatgagcaccgtcttgccgacgccggctccaccgaacagaccgatctttccacccttgacgtacggggtgagaaggtcgatgaccttgacgccggtctcgaacatctcggtcttcgactcgagctcgtcgaagcgcggggccttgcggtggatggaccagcgctcgccgtcgtacttctcgtcgacgttcagcacctcaccgagggtgttgaacaccttgcccttggtgaagtcgccgaccgggacggtgatgcccgtaccggtgtcggtgaccgcggcctggcggaccagaccgtcggtgggctgcatggagatggtgcggaccaggccgtcacccaggtgctgggcgacctccagggtcagcgtcttcttctcgccggcgttggccgggtcggccacctcgacgtgaagggcgttgtacatgtccggcatcgcgtcgacggggaattccacgtcgacgaccgggccgatgacccgggcgacgcggcccgtggcaacggccgtctcaactgtcgtcgtcattacctgtcactccccgcggtcgcgtcggccagggcgctggcgccaccgacgatctcgctgatttcctgggtgatttcggcctggcgggccgcgttggcaaggcgggagagcgtgttgatcagctcgcccgcgttgtcggtggccgacttcatcgcacgacgcgtggcggcgtgcttggaggcagccgactggagcagcgcgttgtagatacggctctcgacgtagcgcggcagcagggcgtcgaggacgtcctccgccgacggctcgaagtcgtacagcggacggatctcgccctgtgtggacgactcctccgccacctcttcgaggctgagcggcagcaggcgggcgtcgatcgccgtctgcgtcatcatcgagacgaactcggtgtagacgatgtggagttcgtccacgccgccgtccgccgtctccttctcgatggcctcgatgagcggacccgcgaccttcttggcgtccgcgtacgtgggctcgtcggtgaagcccgtccacagctccgtgaccttgcgctcacggaagttgtagtgggcggcaccacggcggccgacgatgtacgtgtcgacctccctgccctcggcctcgagccgcgcggtcagctgctccgccgccttgatggcgttggagttgaacgcgccggccaggccgcggtcgctcgtcaggagcagcaccgcggaccgggtgaccgtctcggcctgggtggtcagcgggtgcttggtgttcgagccggtgccgaccgccgtgaccgcgcgggtgagctcggtcgcgtacggcgtggaggccgccaccttgcgctgcgccttgacgacacgcgaggcggcgatcatctccatcgccttggtgatcttcttggtcgcggtgacggatcggatgcgacgcttgtagacccggagctgggctcccatgagtcaggtcccttccttacgtcacttgccggcggccggaacgtcttcgccgagaagcttgccgtccgaggtctcgaactgcttcttgaagtccgcgatggcgtcggcgatggccgtgagggtgtcgtccgacatcttggcgccctccttgatggaggtcatgagtccctggtacttgcggtgcaggaactccagcagctccttctcgaagcggcggatgtcggcgaccggtacgtcgtccatcttgccggtggtgccggcccacacggagacgacctggtcctcggtcggcatcggctggtactgagcctgcttgagcagctcgaccatgcgctgaccgcgctccagctgggacttcgacgcggcgtccaggtccgaaccgaaggcggcgaacgcctccagctcacggaactgggcgaggtccacgcgaagacgacccgagacctgacgcatcgccttgtgctgcgcggaaccaccgactcgggagacggagataccgacgttcagcgcggggcgctgaccggcgttgaacaggtccgactccaggaagcactggccgtcggtgatggagatgacgttggtcgggatgaacgccgacacgtcgttcgccttggtctcgacgatcggcagacccgtcatcgaaccggcgcccatgtcgtcggagagcttcgcgcagcgctccagcagacgggagtgcaggtagaagacgtcacccgggtaggcctcgcggcccggcgggcggcgcagcagcagggacacggcgcggtaggcgtcggcctgcttcgagaggtcgtcgaagatgatgaggacgtgcttgccctcgtacatccactgctggccgatggccgaaccggtgtacggcgccaggtacttgaagccggccgggtcggacgccggggcggcgacgatggtcgtgtactccagcgcgccggcctcttccagggcaccgcgcacggaggcgatggtggaacccttctgaccgatggcgacgtagatgcagcgaacctgcttcttcgggtcgccggtgcgccagttgtcacgctggttgatgatcgtgtcgacggccagggcggtcttgccggtctggcggtcaccgatgatcagctgacgctggccacggccgatcggggtcatcgcgtcgacggccttgtagccggtctccatcggctcgtgcaccgacttgcggtccatgaccgtgggggcctgcagctcgagggcgcgacgaccgctggtctcgatctcgccgaggccgtcgatcgggttgccgagggggtcgacgacgcggccgaggtagccctcgcccacggcgacggacagcacctcaccggtgcggtgcaccggctggccctcctcgataccgctgaactcgccgaggacgaccgcaccgatctcgcgctcttccaggttcagcgcgaggccgagagtgccgtcctcgaacttcagcagctcgttggccatggccgaggggagaccctcaaccttggcgataccgtcgccggcgacggtgaccgtgccgacctcctcgcgcgaggccgcgtccggcttgtacgactggacaaagttctccagcgcatcccggatctcctccggccggatcgtgagctccgccatctgggttccctgctctccttgttgggcccgaagtttcactttggggggatggggactccccctgaaaagaggtgaatcctctgcacggcccaaccagggccgtcggtactactaggtattgagttgctgctagctcgccatgcggcggcgggcgtcctcgagccggtccgcgatgctgccgttgatgacctcgtcgccgacctgcacccgcatcccgccgaggacctcggggtccacgtcgatgttgaggtgcatctgacggccgtagagcgtcgcgagggcggcgccgaggcgctgcttctgcgtgtcactcagcgggaccgccgtggtgacgaccgcgaccaagcggtcgcggcgctcggcggcgagcttggacagggactcgagtcccgcctccaggctacgtccacgcggcgtggtcacaaggcgcgtcacgagacgctcggtggtcgcggtggcccggccgccgagcaggctgtgcaccagctcgctcctggccgccttgtcggcggtgcggtcggtcagcgcggcccgcagcgcggggttcgacgagacgatccggccgaaccggaacagctcgtcctcgacgtcgtcgagcacgcccgcccgctgggccgccgtgaggtcggcgatgtccgccagctcctcgacggcgtccaccaggtcgcgggactgcgaccagcgggagcgcaccatgccggtgaccaggtcggtggcggggccgccgatctggctgccgaagaggcgaccggccagctcggccttggcctcggcggcctgcgccgggtcggtgaggacccgacgcagcgacacctcgcggtcgagcagcgcggtgacggcggccagctcgtcggcgagctggaccacgtccacggacgtcgagtccgtcagcgcatcgagacgctcacgtgcggcagcggttgcctcgcggctcgctccgtgtgcagtcatcgagtcgcctcggccttctcctcgagcccgtcgaggaagcggtcgatgacacggctctgccgggcgtggtcctcgagggactcaccgacgagcttgccggccaggtcggtggcgagcgtgcccacgtcctggcgcagcgcctgcgcggcggccttgcggtcggcctcgagctgggcgtggccggcagcgatgatctcctcgcgctgccgctggccttccgcacgcatctcggtgatgagcgtggcgccctgctcctgcgcctcctggcgcagacgcgcggcctcgtgccgagcctcggcgagctgagccttgtactgctcgagcacgctctgggcttcgaccttcatggcctcggcttcttcgataccgccttcgatcgcggcacgacgctcttccagaaccttgttgatgttcgggaggagcttcttgccgaggacgaagaagacgatcgcgaaggccagaaggccgatgacgagctccgggacctccggaatgaggggattctgggcttcctcagcagccagctgtaccaggatcacatctgtgccttccgtcaaagtttcgcgtcagagaccggatcaggaagggtagacaaagcccatgaccaggccgatcagggccagcgcctcacagagcacgaagccgaggatctggttctggcggatcaggccggccgcctcgggctggcgggcgagggcctgggtgccgttaccgaagatgatgccgacgccgacgcccgggccgatggcggcgaggccgtaaccgatcgcaccgaggttgccctggatgttgaccgcggcgagggtctggagagcggacatgccgtttcttccttctttttcacgggccggtgggggttggccaccggatgttcgggggggtgccgtgctcagtggtgctcggcgagagcgccctggatgtagctgcaggacagcaggatgaagacgtaggcctgaagcgcctggatgaacagctcgaagaccgtcatcacgaggaccatcaggaacgagacgccggcgtaggcgatgccgatgccgttgagcaggtaccagctggcgatggtgaagatcagcagcagtacgtgcccggcgaacatgttggcgaagagccggaccgcgtgcgtgaagggccggatgagcaggttcgagaggaactcgaagaacatgaccaccgggaacaccgggccgagcgacttgtcgtagcccgtgatgttcttgaaggcgccgacgaagccgtgcttcttgaacgtcaggctcacccagagcacatagacgaccgctgcgaggcccgccgggaaggcgatgatcgaggtcgccgggaactgcgcgaccgggatgatcgaccagatgttcatcatccagacgaagaagaacaacgagaccatgagcgggacgtacttgtcgccctcccgcttgccgagcgtctcgtagacgaccccacgacgaacgaagtcgtagcccagctcaccgatcatctggagcttgcccgggatcagcttcggcttgttgaaggccgcccagaagaacccgatgacgatgatcgtgctcagcagtaccaacaggatcggcttgttgaactcgaagccgccgaccgtgaagatcggctcgaagacgaaggagtgcagaccgggggtcgggaaaccgcacccttcgaaaatatgacaatcggtctcgaaggcgagcgtcttggcatcactcaccgcgagctccttcagcgtggcgcatgggtacggcaacctcaatgtgtcggcgcggcctgcgaccgcggaacggcactggactggacttgcggatatgggggcggcgactgggctccgagccaaaaggcgtcacaggcacggctaccacccacgccagctctgccacagttgtggcgagaccatagcaaatgagcggaggcccctttacaccggccctacaggtcacgacggcgtccgagcggagtccggctccacgtagaggaccttggccttcatgtgggatcgcacctgtgcagcgatccacaccagggtggccgcaagcagggtcagggcgaagcacttgggattgaacaccgaggtgcccctgaagatggtcaacaggatcatcaggagcaggatctgcgtggtgtagagcaacagccccatcatctggaacaggtggggcagcgagcgcgcggtccgcagcagcaccacaaggccgctgcacatgaacagcagaacaagaacggtgccgaagccggcgcctagcgcacccttgccaccggccacggcggcactgaccgcgactcccaccacgcccgcggcagcggtgggcagagcacagtgcaggagcgttcgggcgtcgttggactgcattgcggcagctcctccggcgaaatcttggggggggttcgtttcggtcgtcgagagatgaccctagcccgaggtgaacgaggcgtgcctcgtacgggcggcctgtctcgctccggccgccccaatatatctcgggttctcgtgaaccgtatcacaaactatttgatgcagtctttacccggaagtgtgctcaccgtcacacgaacgggccatgcggtagctcagcgagatgacaccgcgggtgtggacttggtatgcgcgcgtgatcgcgagcgcgggcggtgcgcgcgtgctcagtacgtgtagaaaccctgcccggacttcctgccgagcaggccgccgtcgaccatgcgggacagcagcgggggaacggcgtgcgtgggctccttgaactcctcgtacagggccgtgccgatggccgcgacggtgtccaggccgatgaggtcggccagtgccagcggtcccatggggtgcgagcagcccagtgtcatcgctttgtcgatgtcctgcgcgccggcgaatcccgcctcgcacatcctgatcgcggacaggagataggggatcagcagggcgttgaccacgaacccggagcggtcgccggcgtggacgacctgcttgccgagcaccgtggtggcgaactccgcggcgatgcgccgggtgcggtcgcgggtgagcagcgaaccgatcacctcgaccaggggcagcacgggggccgggttgaagaagtgcaggccgaggacctggccggggcggtcggtcgcgcgggccagccgcatgacgggaagggcggaggtgttggtggcgaggatcgcctccgggtcctcgacggccctgtccagcgcctggaagatccgcagcttcgtgggctcgtcctcgggggccgcctccaggaccagttgccggtcgcggaaggcggcgaggtcggtggtgaaggagacgcgggcgagcgtctcttcgcgggccgtgtcgctgatcctgtccttgcggacggcgtgggcgagggagcgttcgagccggccgcggccccgggccagcccgtcctcgcccgaggacgtgaccagtacgtcgagcccggcccgggcgcacacttcggcgaggcccgcgcccatcactccgcagccgaccacgcccacgcgccggatcgcccgcgcggcggcggactcctcggtcgcctcgggctcggtcgcctcgggcgcggacgtggtcacgggggtcggggaggccgccgtcgcagtgctcatcacatctccttcgcgccgggcacggcccgacgggctctctcggccgattaccagcgtcttcacgacaggcgtacgggaactggaggcgctctcagccggcctgtcgcgtcggtgtgagtccgcgcagcgggttgaggcgttcctcgcccaggtcggcacggcgttcggggtccgtcacgccctggccggggcccgatgccaggcacaggactccgaccttgccgatgtgctggttcgtctggaccgaccgggcggcctcgccgatctcctccaggggatagaccgcggacagcgtcggcacgatgcggccgagggagacgaggcggttgcactcccattgttcctggaggttcgccgcgtggctgccgatgattcgcttgagtttcatccacaggtagcggttgtcgtagccgtgctggtagccggtgctggagccgcaggtcaccaccgtgccgccgcgccggaccacgaagaccgagaccgcgaaggtggcacggcccacgtgctcgaagacgatgtgcgggtcctcccccacccgtttgcggatggcggtcccgagccgcttgcccacctcgatcaccgcacgggggtcgtcggccgtgcggtcgtcgaggccgatgtcctggcggtcgatgaccacgtcgcagccgagtctgcgggccgcctccgccttggcgggcgagctgaccacgccgaccgggatgccgccgccgttcttgacgagctgcaccgcgtacgcgccgagtccgccggcggcgccccagatcagtacgacgtcgccctgcttgaagcgggcgccccggtcgccgacgagcatccggtacgcggttcccgcgcacagggggttgcaggccgcctcctcccagctgaggtgggccggcttggggatcaactggcttgccctgacgaccgcgtagtgggccaggccgccgaagttggtctcgaagccccagatccgctgctcggcgccgagcatcccgtcggcctgcgtggccggttcctggtcgtcgggctggacgcagctcatcaccacgtggtcgccgatgccccagcgccgtacgccggagcccacgcgcacgatcacgcccgccccgtcggaaccgatcacgtggtacggcagatcgtggcgtcgggcccaaccgccctgcgtcgcgaactgccgcaggaagcggaacgtggagaccggctcgaacatcgccgaccacacggtgttgtagttgaccgcgctggccatgaccgcgaccagcacctcgtccggcgccagttcgggcatcgggacctggccgacgcgcaacgacttgcggatgtccttgtcggcgactccgtcgaacatccgggcgtcctcggcctggatgtacgcggcggtgtactccccgggcagcggcgcgcgctccagctcctgcggcggcgcgcccgcacgtaccgcttcggtcagcagggtcatggttcacctttcccgggggtcacgtagcccgagcgtcgatccgtatgcgtgggtccacggcgttccgctgttccgtccttaccgaattaccgcggctccgaattaccgaatggccgggatcctggggaccgctcggtgggtcacgcctcgcggtggcagtgcacctcgtccgcggggatccagtcgccttcgtcgaacttgatgaaaccgcgtttgacgtagtgcttctcgtcgacgatttcgtactgctccttgagcaggaaggacttgccgaatccgaagcattctccggtgaacgcgagataaccgtcctgccagccctcggaggtcagcagggtgcggtttccccagtcgtcgtagtagtagccggagaacgacgattccgactcgacccactggacgacgaagcggccggtgaggtcgtgcgcctcgacccgctgcgtcatctcgtaggcgtgcccgtggaaggtggacgcggtgttccaggcggccgtgccggtcgtggccgggtcggcggtgaagttggtccactccgcacggaaatcaccgagcaggaaatccagatcccgcatcttctccggggccggcggcctggtgaattcctgctcggccgaagtttcggcttccttctcagaaacgctcattgcggaatacactccagttcctcgtcacggcacgggaattcgccgaatgctaggcacggccgcacccctagcgccaacccctacccggccgcattcccgggcgaggccgcttctggggtggctgaggggacgcggctaggggcgagccgtccgtaccttcgccctcgaagggcgcggtttgccaatctctcaggcaggttcacaggtgacgaacgaagcgcagctggttgattacctcaagaagatggcagccgatctgcggcaggcccatcggcgcatcaagaaacttgaggccgacgacaccgagcccatagcgatcgtcgggatggcctgccggctgcccggcggtgtcggctcacccgaccagctgtgggacctcgtccggcgcggtgaggacgccgtcaccggcatgccgacggaccgcggctgggagctcggggagctttacgaccccgaccccgaccacccgggcacctcgtacgccaccgagggtggattcctgcgcggggccaccgagttcgacgcggagttcttcggcgtctccccgcgcgaggcgctggcgatggacccgcagcagcggctgctcctggagaccgcctgggaagccctggagaacaccggtctcgatccgcggtcgctggccggctcgcgcaccggtgtcttcaccgggctgatgtaccacgactacgcctcgggtcccggtgccctgcccgacgaggtcgagggctatctgagcaccggtatggccgcgagtgtggcctcgggccggatctcgtacttcctcggcctcgaggggccggccgtcaccctcgacaccgcgtgctcgtcctcgctggtggcgctgcacctcgccgtgcaggcgctgcgggacgaggagtgcgacctggcgttggcgggtggcgcgacgatcatgtccacccccgccaccttcgtggagaactcgcggcagcgcggcctcgcccgcgacggcaggtgcaagtcgttcgcggccgccgccgacggtgtcggctggggcgagggctccgcgctgctcgtggtggaacggttgtcggacgcccgtcgcaggggccaccaggtgctcgcgatcgtccgcggcagcgcggtcaaccaggacggcgcgtccaacggtctcacctcccccaacgggccctcgcagcagcgggtcattcagcaggcgctggcctcggcgcggctcggcgtcgcggatgtcgacgtggtggaggcgcacggtacggggacgacgctgggtgatccgatcgaggcacaggcgctgctggccacctacggccgggagcggagcgccgagcagccgctgtggctgggctcggtcaagtcgaacatcgggcacacgcaggccgccgcgggtgccgccgggatcatcaagatggtccaggcgatgcggcacgagcagctgccgaggacgctgcacgtggaccgtccgacgcccgaagtggactggtccgagggcgcggtggagctgctgaccgagaaccgcccgtggccgcgcggcgaccgcccccgccgggcgggggtgtcctcgttcgggatcagcggcaccaatgtgcacgtcatcctggaggaaccggcgccggcggatctcgacgcggacggcccggccggggcgagcggctcggccggcgcggacggcccggccggcgcggacggctccgtcacttccatcgcctccggcacctccgacacttccggcgcttccatcgcctccggcgcttccgtcgccggagcgcaggtcgtgccggtggttctgtcggcggccacgcccgcggcgctgcccgcccaggccgcccggctgcacgcgcacctgctcgaccaccccgatctgccgctcgacgacgtggcctgcgcgctcgccacgacccgtaccgccttcgagcaccgggcggtgctgctcgccggggaccgcgcggaactgctggactcgctggccgagctggggcggggaggcagtcccgccgggctggtgagcggactcgccggcgaggtgcgcggcgcgttcctgttcaccgggcagggagctcaacgtcccggcatggggcgggagttgtacgaggcgttcccggcgtacgcccgcgcgctggacgccgtctgtgccgagctggacgcccggctcgaccggccgctgctgccgctgctgctggccgccccggacagcgaggaggcgcggctgctggaccgtaccctctacacccagtcggcgaccttcgccctcggggtggccctgttccggctcctcgaggagtggggtgtgcgtccgcggctgctgtccgggcactcggtcggcgagctgaccgcggcccatgtctcgggcatgctgtcgctggccgacgccagtgaactggtcaccgcccgggggcggttgatgcaggaactgcccgagggcggggcgatggtctccgtggcggcgacctgggacgaggtgctgcccctgctggccgggcacgagtcggtggccggtgtcgcggcggtcaacgggccgggttccgtggtggtgtcgggcgacgaggacgtcgtcaccgccgtcgcggcgcacttcaccggcctggggcgcaggacccggcggctcccggtgagccatgcgttccactcgccgctgatggaccccgtggtcgacccgctgcggcaggtcgccgcccggctgacgttcggtccccctgccattccggtcgtctccagcgtgacgggcaccctcctggagccggccgcgtgggcggacccggcgtactgggcgcggcaggcgcgcgagccggtccgcttccacgacgtggtgcgcgccctcgacgccgagggcgtcaccgtgttcctcgaactcggggccgatgccgcgctcacctccatggccgaggagacgctcgcgtccatggccgaggagacgctcgcggaaaccggcaccgccggcgcggtcgtcgcaccggcgctgcgccgcaaccggccggaggtccgcaccctgacggccctgctggcccaggcgcacacggccggtgtgccggtggactgggcggcgttcttcgccgggcgggcgggacggcgggtgccgctgccgacgtacgccttccagggcacccggtactggctgcgcggcgtgcccggggccggcgacatggccgcggcggggctggcccccgcggaacacccgctgctcggtgccgtgctggtgccggcggccgggggcggccggctgttcaccggcaggctgtccacggacagcctgccgtggctggcggaccacgcgatcggcgacaccgttctgctgccgggcaccgccgtcgccgaactggcgctgtgggccgggacgtacctcggcctcgactcggtcggggatctcacgctggagcttccgctcgtcctgccgtcgagcggcggcctgcgcgtccagctcgccgtgggtgctccggacgagtccggcgagcgtgagttcgccctgtacgcacaggccgaggagtccgccgaggaggtgtggacgcggcacgccggcggcaccctcaccacggctcgtacgcgtcccggagacgagctgacggcctggccgcccgccggggccgaggagctggacgtcgacggcttctacgcggacctcgcggacgccggtttccagtacggcccggccttccaggggctgcgcgcggtgtggcggcggggcgaggaggtgtacgttgaggtccggctgcccgacgaggtggccaccggcgccggggagttcgggctgcatccggcgctcgccgacgccgcactgcacgcgtccgcgttcgtgccgggcgagttcggccgggagcagcggggcaggctgccgttcgcgtggcgcggggtggcgctgcacgcggccggtgcgtcgttcctgcgcgttcggctgacgccgaccggcgccgactcgctctccctgttcttcgccgacgccgccggtgaggccgtggcgacggtggactccctggtggtgcggcccgccgggcggatcgcggcgccggacggtgcctcggacgccttgttcgtgccgtcgtgggctccggtcggcgcggccgagccggagggccgctgggcggtgctcggttcggggccgctcacggggctcgcgggcgccgagcgtcaccccggcctggcggggctcggtgccgcgctggacgcgggtgccgggatgccggagttcgtcgtcgccacggccggcccgtccgagggctcgggtggcgcggacgcggcggacgacctcgccgggcaggagcgcgaccttgccgggcaggcgcacgacctcgccgggcgggcgctggacctggtgcggtcgtggctggccgacgagcggttcgccgactcgcggctggtggcggtgacctggaacgcggtggccgtgggtgagggcgacccgctcgacccggtgcaggcggccgcgtggggcctgctgagctcggcggtgaccgaacacccgggccggatcgtcctcgtggacgtcgacggcacgccgcggtccctggcggcggtgcgctcggcggccggctcggacgaaccccgggtcgccctacgggacggcagggccttcgctccgcgcctgacccgggccgtggcggacgacgccgtggcaggcgacgccgtgccgcgggagatcgatccgcacggcaccgccctcatcaccggcggcaccggcaccctcggcgccctcctcgcccgccacctcgtcacccggcacggggtgaccagcctgctgctcaccagccgacgcggaccccacgcccccggcgccaccgaactcgtagccgaactcaccgcagccggcgcccacgtcaccgtcaccgcctgcgacaccaccgaccccgaacaactcgccaccctcctcaccaccatccccaccgaacaccccctcaccaccgtcatccacaccgcaggcaccctcgacgacgccaccaccacgaagctgaccgacacccaactccacaccgtcctccaacccaagatcgacgcagccacccacctccaccacctcaccctccaccaccccgtcaccaccttcgtcctctactcctccgccgccggacaactcggcaccgcaggacaagccaactacgccgccgccaacacctacctcgacgccctcgcccaccaccgccgcacccacggacaccccgccacctccctcgcctggggcttctggaaccaacgcagcgacatgacagccgaggtcgacgagcagacgcggcgccggatggccggtgccggggtgctgccgatctccgaggagcagggggcggccctgttcgacgcggcgctcgcgctggacgctccggtcgccgtgccgctgccgctggatctcggcgcgctgcgggcgcaggcggccgtgggcaccctgccgccgctgttccggggcctggtgcgggcgccggtgcgccgggcggccggtgcggtcgacggagccggtgcgcaaggggcgttcgcggcccggctgcgggcgctgccgcgggcggaccaaatccggctgctggtggacctcgtacggacccacgcggccaccgcgctcggccatccgacgcccgacgggctggatgcgcggcggaccttccgggagctcggtttcgactccctggccgccatcgagctgcgcaacggcgtgggtgccgcgaccggtctccggctgcccgcgaccctggtcttcgaccacccgacgccgtcggccgtggcggaggtcctgctcggcgagctgaccggcgggcaggaggcgtcgccggcaccccgggcgtccgccgccgtcgagcccggggagccgatcgcgatcgtgggcatggcgtgccgttatcccggcggggtggcctcgccggaggagctgtgggagctggtcgccgcagggcgggacgcgatcggtgacatgcccgaggaccgcggctggaacgtggaggagttgtacgacccggagctggcccggccgggcacctcgtacgtgcgggagggcggcttcctgtacgacgcggccgagttcgacccggagttcttcgggatctcgccgcgtgaggcgctggcgatggacccgcagcagcggctgctcctggagacgtcgtgggaggcgctggagcgggccggcatcgatccgcgggcggtgcgcggcagccggaccggggtgttcgccggggtgatgtaccacgactacggcgccgaccaggccgtactgcccgaggaggtcgaggggttcatcgggaccggctcggccggcagtgtcgcctcggggcggatcgcgttcacgctgggtctggagggtcccgcggtcacgctcgacaccgcgtgctcgtcctcgctggtggcgctgcacctggcggcgcaggcgctgcgcaccggtgagtgcgacctggcgctggccgggggcgtgaccgtgatgtcgacgccgggtgtgttcgtcgagttgtcccggcagggcgggctgtcccccgacggccgctgccggtccttcgccgagagcgcggacggtacgggctggggcgagggtgccgggctcctgctggtcgagcggctgtcggacgcccgccgcaacgggcaccccgtgctggcggtcgtccggggcaccgcggtcaaccaggacggcgcctccaacgggctgaccgcgcccaacgggcccgcgcagcagcgggtgatcgaacaggcgctggcgaacgcgcggctcggtggcgccgacgtcgacgtggtggaggcgcacgggacggggacgacgctgggcgatccgatcgaggcgcaggccctgctggccacctacggccgggagcggagcgccgagcagccactgtggctggggtcggtgaagtccaacctgggccacacgcaggcggcggccggggccgcgggcatcatcaagatgatcatggctatgcggtacggggtgctgccgaggacgctgcatgtggaccggccgtcgcccgaggtggactggtccccgggcaccgtggaactgctcaccgaggagcgggagtggccggacgcgggccgtccgcgccgggccgccgtgtcctcgttcgggatcagcggcaccaacgcccatgtcatcctcgaacagccgcctgccgacgacgagcccgggacatccgggacggttccgggcggcgtggtgccgtgggtgctctccgggcacgaccgggccgcgctgtacgcccaggccgagcggctcgtcgcgcatgtggcggcgcgtcccgagctgtccgtggccgatgtcggcaggacgctgacgggccgggcccggctgtcccaccgcgcggtggtgctgggcggcgaccgggacgagctgctggccgccgcggccgggctggcgcgccgggccggggagccggacgaggcgctgccgccgggtgtggtcgaggggtccgtgctcggcgacgaccgcgtggtgttcgtcttccccggccagggcgcccagtgggcggggatggcggcggaactgctggtctccgcaccggtgttccgggcccggatcgaggagtgcgaggaggcgctgcgcccgtacgtcgactggtcgctgctcgccgtcctgcggcaggagccgggcaccccgccctgggaccgggtggacgtggtgcagcccgcgctgtgggcggtgatggtgtcgctggcggcgctgtggcgttcgtacggcgtcgaaccggacgcggtgctcgggcactcgcagggcgagatcgcggccgcctgtgtctgcggggcgctggacctcgccgacggcgcccgggtcgtcgccctgcgcgccagggcgatcggctcgacgctcgcggggcggggcgggatggtgtcggtggcgctgccgtcggcggcggcccgggagctgatcgccgggtggccggggcgcgtctcggtggcctcggtcaacggtcccgtcagcaccgtggtggccggtgatcccgacgcgctcgacgaactgctcgcccgctgcgccgacgacggcgtgcgggcccgtcgcatcccggtcgactacgcctcccacacatcccaagtggcggagatcgagggcgacctggccgccgaactggcggggctgacgccgcgttcgtcggcgatcccgttcttctccaccctcaccggggccccgctcgacaccgcgaagctggacgccggctactggtatcagaacctgcgtcacaccgtggagttcgaggcggcgacccgcgcggcactcgaccagggcttcaccgtcttcgccgagatcagcccgcaccccgtgctggtgccctcggtccaggacacgatcgacgatacgggccggaccgcggtggcggtgggctcgctgcgccgggacgacggcggcgcgcggcgctttttcacctcggccgccgagctcggtgtgctgggcgtcggcgtcgactggccggcggtgttcgacggcaccggggcccggcaggtggacctgccgacctatgcgttccggcgccgccggttctggctggagtcccgccgcggcgcgggcgatctgtccgcgaccggtctcgaggcggcgggccatccgctcctcggcgcggccgtgtcgctggcgggcggcgagggcgtgctgctcaccggccggctgtccgggcgtagccatccgtggctgctcgaccacgccgtctccggcacggtcctgctgcccgggaccgccttcgtggacctggcgatccgggcgggcgaccacctgggccgtccccatctggaggaactgaccctccaggcaccgctgttgctgggctccggccccaaggacgaggtcacggtgcaggtccgggccaccccggacggcgagacgggcacctgcacggtcaccgtccactcccgtaccggcgaggacgactggacgctgcacgcgaccggcaccctcggcctggacgcgcccgaggaacccgcgccggatccggcgtggccgccggccggcgcggagccggtcgacacggagggcgtctacgacggactcgccgagggcggctaccactacggccccgccttccagggcctgcgcgcggtgtggcggcgggacggcgagctgttcgccgagatccggctgcccgacggcgagcgggaggaggccgcgcactacggcgtccacccggccctgctggacgccgcgctgcacgccatggtgctcgccggcgaccaggaggcgggcgtgaagctgccgttctcctggaccggggtgcacctgtacgcgaccggcgccaccgcggcccgggtgcggctcaccccgtccggggaccagctcgcgctgctgctcaccgacgagacgggccgcccggtcgtctcggtacggtcgctggtgaccaggcccgccgccctggccgcccccggccggtccacgggcggcgcgctggaggaggcgctgctccacctccactggacccccctgaccgtcacggttgacgagccggccccgtcgtacgcgctggtcggcgccgacctgttcgggctggcgggcgaccgtgccggcgtacgggtgggggcggatctcgacgagctgggcgcggccgacgggccggtcccggacatcgtggtgcactgcctcgcccccggtgcgccgggcgatcccgcggcggcggcgcacacggccgcccaggagacgctcgaccgggtccgtgcctggctggccgacgagcggttcggctccgcgcggctggtgttcgtgtcctcgggcgcggtcgcggcgggcgacgacgaggatgtcaccgacctggggaacgcggcgagttggggcctggtgacctcggcggtgtccgagcacccggaccggttcgcgctggtcgacctggacggcacggccgagtcccgggaggtgttcgcggcggcgctggggtgcgcggagccccggctcgcgatccgcggcggcacggtcacggcgccccggctggcccgcgcccaggcgcatccggcgctgctgccgccgcccggcccgacgccgtggcggctggagagcaccggccgcggcacgatcgagaacgtggcgctggtcccctgccccgaggtcctggacccgctcggtcccggccaggtccgtatcgccgtccacgcggtcgggctgaacttccgggacgtcgtcgtcgcgctcggcatggtcgaggggcagaacggcatcggcggcgatgtcgccggaacggtcctggagaccggtgccggggtgggcaacgtcgcggtgggtgaccgggtgctggggctgtgctccgactcgttcgggccggtcgcggtgtgcgaccaccgttttctggccccgatgccggacggctggtcgtacgagcaggcggcggccgttcccatcacgcatctcacggcctactacggtctggtggacctggcggacgtgcagccgggcgactcggtgctggtgcacgcggcggccggcggggtcggcatcgcggccgtgcagctggcccgtcatctgggcgccgaggtctacggcaccgccagccccggcaagtggcggacgctgcgcgaccacgggctcgacgccgggcacatcgccaactcacggaccctggagttcgagcagtggttcatggagggcagcagcggctgcggcatggacgtcgtactggactgtctggccggtgagttcgtcgacgccgggctgcggctgctgccgcgcggcggacggttcctggagatgggcaagaccgacaagcgcgacccggcgcgggtcgccgccgcgtacccgggcgtggcctaccaggcgtacgacctgatggaggcgggccccgaccggatccaggagatgctggtcgcggtgctggagctgtaccgcgccggggtgctggtgccgccgccggtcaccacgtacgacctgcgccgggcccgtgaggcgatgcgggacctgagccaggcgaagctggtcggcaaggccgtgctcaccgtgccgcgggggatcgatccgcacggcaccgccctcatcaccggcggcaccggcaccctcggcgccctcctcgcccgccacctcgtcacccggcacggggtgaccagcctgctgctcaccagccgacgcggaccccacgcccccggcgccaccgaactcgtagccgaactcaccgcagccggcgcccacgtcaccgtcaccgcctgcgacaccaccgaccccgaacaactcgccaccctcctcaccaccatccccaccgaacaccccctcaccaccgtcatccacaccgcaggcaccctcgacgacgccaccaccaccacactcacggacacccaactccacaccgtcctccaacccaagatcgacgcagccacccacctccaccacctcaccctccaccaccccgtcaccaccttcgtcctctactcctccgccgccggacaactcggcaccgcaggacaagccaactacgccgccgccaacacctacctcgacgccctcgcccaccaccgccgcacccacggacaccccgccacctccctcgcctggggcttctggaaccaacgcagcgacatgacgggccacttgggcgacgccgaggtggaacggatggagcgggcgggcatgcggccgctggacaacgaggaggggctcgcgctgttcgacctggcgtgcggggccgacgtaccgctccaggtgatcacccggctgacggcgtcggcgctgcgggccgacccggacagcgttccgccgctgttccgcggtctggtgcagggcacctcgcggcgggtggtgcggtccggcggcgacggggccgagctgcggacgcggctgaccgggctgcctccagccgagcagcttcgcaggctgctggacctggtccgttcgaacgcggccaccgtgctcggccacgcctcggccggggcgatcgcggcggagcagtccttcagcgagctcggcttcgactcgctgaccgccgtggagttccgcaaccgactcggcgcggccacgggtctgcggctgccggccacgctcgtcttcgagcatccgacgccggccgcgctcgccggggaactgctcacgcagctcgccccggccgggctctccggcgccgaggccgccctctcccaggtcgacgccctggaggccgccctcgcggcggtcaccgctgacgacggggaccgcgaccgggtcacccggcggctgcgcgggctgctggcgcagtggagcacgggcgatgccgaaccggccgcggcggacgccctcgacgacctcgacgcggccagcaccgacgacctcttcgacgcgatcgaccaggggttcggtctctgaccgacggcacagacccggtccttcgaccggaccggaccctgcccttcgaccggcccggaccgaaccagaccggatcggaccggatcgacccggatcagtccgatcagtcccgatcggccgggcacacctcaccaaggagctgtagcgaatgtccgacgaggagaagttccgcgactacctcaagcgggccgtcaccgaggcacgcggactccagcgccggctgcgcgaggtcgaggacaaggcgcgcgagccgatcgcgatcgtcggcatggcgtgccggttccccggcggggcccagaccccggaagacctgtggcacatggtgtccgagggcgtggacgcgatctcgggcttccccgacgaccgcggctgggacctggaccggctgtaccgcaccgacgccgaggagtccggcgcctccaccacactggagggcggattcctgcacggcgcgggcgagttcgacgcggacttcttcgggatctccccgcgcgaggcgatcgcgacggacccccagcagcggctgctcctggagacctcgtgggaggcgctggagcgggccggggtggacccgcgatccctgcgcggcagcgtcaccggggtgtacttcggcggtacgggcggggacttcgccggtctgctggccgcgtcgccgcaggcactggacggctacatgctgaccggcacctccagcagcgtgctctccggccgggtctcgtacgtgctcggtctggaggggcccgcggtcacggtggacacggcctgctcgtcctcgctggtctccatgcatctggccgtgcaggcgctgcgcaaggacgagatctcgctggccctggccggcggtgtctcggtcctcgcgacgcccggcgcgttccccgagttctcccgccagggcgggctggcctccgacggccgctgcaaggcgttctcgtccgacgccgacggcaccggctggggcgagggggtcggtgtcctcgtcctcgaacggctctccgacgcccggcgcgccggacacccggtgctggccgtcgtacgggagaccggcatcaaccaggacggggccagcaacggcctcaccgcgcccagcggccccgcgcagcgccgcctcatcctgcgcaccctcgacgacgccgggctggccaccgcggacatcgacgtggtggaggcgcacggcaccggtacgaaactcggtgaccccatcgaggcacgagcgctgctggccacctacggccaggaccggccggccgaccggcccctgtggctgggctccatcaagtccaacatcggccacacccagtacgcggccggcgtcagcggcgtgatcaagacggtcatggcgctgcggcacggcgtcatgccgaagaccctgcacgtggacgagccgacgccgcacgtggactggtcctcgggtgcggtgcgactgctgaccgagaaccgcccgtggcccggccacggccgcccccgccgggccgccgtgtcctccttcggcgtcagcggcaccaacgcgcatctgatcctggagcaggcgcccgaagcggccggggcgacggactcggcaacggactcggagacggagtcggagtcgcagtcgaagtcggaggagcacggtgcggtcgtgacgccgccgttgatcccctgggcgatctccgggcggggtgaggccgcgctgcgtgcgcaggcccagcggttgctggaccgtctctcggagcgtcctgacctggagccgctggacgtgggcctcgcgctggcgcggacgcggtcggcgttcgagcagcgggcggtggtgctgggagccgaccggacggaactggtcgcggggttgcggtcggtggccgagggggccgccgtcggcgccggcgtggtggcggggcgtgccgccgagtcaggtgtggtgttcgtgttcccgggtcaggggtcgcagtgggtggggatggggcgggagttgtgggacgcctcgccggtgttccgtgcgcggatggaggagtgcggccaggcgctgagtccgtacgtcgactggtcgttgagggatgtggtgttccgggacgcgggggatccgttgtggtctcgggtggatgtggtgcagccggtgttgtgggcggtgatggtttcgctggcggcggtgtggcgttcgttcggggtggagccggccgctgtcgtggggcattcgcagggtgaggtcgctgcggcgtgcgtggccggtggtctgtcgctggaggatggcgcccgggtggtggcggtgcggtcgcggctggtgctggagaagctgtccggtaagggcggcatggtgtccgttgcgctgccggtcggggacgtcgaggagcggctggcgcggttcgagggccggatcggtgtcgcggccgtcaacgggcccacctccgtcgtcgtctccggtgagcccgacgcactcgacgaactcctcgcggaatgtgaggagtcgggggtacgggcccgtcgtatcgcggtggactacgcctcccactccgcgcaggtcgacgccctcaacgacgacctgctcgccgaactcgccgacatccggcccaagtcgtccaccgtcgccttccactccacggtgaccggcgagcaggtggacacctccgggctcgacgcccgctactggctgcgcaacatgcgggagaccgtcgccttcgaggccgcggtgcgcgccaccctcgacgaggggcaccggaacctgctggagatcagcccccatcccgtggtgaccatggccgttcaagaggtcatcgacgcggcgggcgtcatggcccaggtgtccggctccgtgcgccgcgacgagggaggcctcggccggctgctgacctcgctggccgaggcgtacgtcgcgggcgcgcccgtcgactgggcgcgggtgttcgacggcaccggcgcgcggccggtggacctgcccacgtacgccttccagcggcagcggtactggctgcgcctgccgtccgccgggtccggcgacgtgacgtccgtcggtctgcgctcccccggacatccgctgctcggggccgccgtggagcccgccgagtccgacggcctcgtactgaccggccgggtctccctgcgcgagcacccctggctggccgaccaccgggtcatgggcacggtcccgctgccgggaaccgcgttcgtggagctggccgcgacggcgggcgacctcgtcgagtgcccgcacatcgaggaactgaccatgcaggcccccctcacgctgcccgagaccggtggcctggacctccagctcacggtgagcgcaccggacgagaccgggcggcgcgagatcgggttcttcgcccgcgcggacgacgagatcgcggcggccgcctggacgcggcacggcacgggcgtcctgtgcccggccggtcccgtaccggaggcggcaccggccgtctggccgccgcgcggtgccgagccggtcgaactcggcgacctgtacgggcagttggcggacgggccgttcgcctacgggcccgccttccatgggctgcgggctgcctggacccgggaccggaaggtcttcgcggaggtacggctcccccaggaactgcacgagcaggcgggtgagtacctgctgcatccggcgctgctcgacgcggcgctgcacgcggtgggcctgggcgaactgctggacaccggcgggcagccgctgcgcccgttcgcctggaacggtgtgtccgtgcacgccaccggtgccaccgctttgcgggtgaccctgacgccggcgggggcgaacgccgtgtcgctgtacgccgccgacggcaccggtgccccggtcgtcacggtcggttcgctgctgctgcggccggtcgacgtgacggagccgggggcccggccgccggccgccgcgcactcctcgctgctgtccctgacgtggacgccggttccgttgcccgccgtcggtgccgtgccctgggcggtgctgggggaccggccgtcgtgggcgggcccggactccggtgccgtgtgccacgccgacctggacgcgctcgcggcgtcggtcgccgcgggtgaccccgtgcccggcttcgtcgtcctggatccggcggccgggggccgcgacgacgacgggcatcccgccgtcgcccgggaacgtgccgcgcgggtgctggagtcggcgcgggcgtgggtctccgaggacctcgacgaacggctcgccccggtgccgctggtggtggtcaccagggacgcggtgggcacctcggcggacgatccggtgaccggcctcggctccgccccgctgtggggcctcgtgcggtcggtccagtcggagaatccggggcgtttcgtgctgctggacaccgacggcgaccccgagtccggacggtccgtgccgggcgcggtcgcgtcgggagaacccgagatcgcgttgcgcggcgggtccgcgctggtcccgcggttgagccggatggcggtcaccgagctccccgacccgacgcccggtacgcggcccggtacggggggtacgggactcgacgacgtgcccggtacgggactcgacgtgcccggtacgggactcgacgcgctcgacccgtcccgcacggtgctcgtgaccggggcgacgggcggtctgggcacgctggtcgccggccatctcgccgaacggcacggcgtacgccacctgttgctgctgagccggcgcggcccggaggcggagggcgccgaggagctggtcggccggctggagaagctgggcgccacggtgacgctggtcgcctgcgacgccgcggaccgcgaggcgctggccgccgtactcgccgggattcccgccgcacatccgctgaccgcggtggtgcactgcgccggaaccgccgagaacgcgctgctggcagcgctgaccccggagctgatcgaccgggtcttccgcgccaaggtggacgcggcggtgcatctgcacgagctgaccgagggcctggacctgtccgccttcgtcctgttctcctcgatcgcgggcaccctcggcggcaccgggcagggcaactacgcggccgccaacacgttcctggacgcgctcgcccggcaccggcgcgggcgcggtctgccggccacctcgctgggctgggggctgtgggcggccgagcgcggcatgggcggcggtctgaccgacgcggcctcggcgggcactcccatgcgcggggtgtccgcgctgccctccgacgagggcctcgccctgttcgacctcggctggcgctgcgccgagcccgtggtgttccccgctcgcctcaacggggccgcgctgcgcgcccaggccgccgccggctccctgccgccggtgctccgggggctcttccgcggcccggcccggcggacggcggaggccggcggtcaggactcgggcgcccaactgcggcgtcggctcgcggagctgatgccggtcgagcggcaggagaccctgctggccctcgtacgcgaccggatcgccgccgtgctcgggcacgcctcctcggaccggatcgagacggaccggccgttccgcgacctcggcttcacctcactgaccgcggtggagctgcgcaaccggctgaacgcggcgaccggactccgactgcccgtgagcctggtcttcgactatccgacgctgggcgaactggtggagttgctggcggggaagctggtcccggacggcaccgaaccggccgcgcggcccgaggacgaccgggaggcggccgtgcgccgcaccctgctgtccatcccgctcgcccggctgcgcgagcacggactgctcgacacgctgctggccctcgccgacgacggcggggcgcagccggaggcggccgaccgcagcgacgagatcaagtccatggacgtggccgcgctgctcgccatggccaggagcaccaccgcgagctccaccgcgagcaccaccgctcaatagccgggcccgtccggcacgttgtgcgagtggggccccataggggacggggctaggggcggggcgtgcatagcctgcacgcacggaggcctgtgaaccctcgccacgtccgacaaccctcgccatgtccgacaaccctcgccacgtctgataaccctcgccacgtctgacaaccctcacgaatctggagagctttccatggccgaagcgccttccgagcccatcgcgttcccgttccccgacccgccgtcggtctgcgagctgcctcccgagctggcggagatccgcgacggccagtccgtggtggaggtgaagttccccgacggcatcagcggatggatggtgaccaagcacgccgatgtccgcaaggtgctggtcgactcccggttcagcagcaaggtgatggccaccgcggccgccgcgatgtcggagaccgagaccggcaagctgatgaacgagtcgctcgtcggcatggacgcgccggagcacacgcggctgcgcaagctggtgaccaaggcgttcaccgcgaggcgggtggagacgctgcggccccgcatcacggagttggtcggccagctgctcgacgagctggagacgctgccccgcccggtggacctggtcaagaacttctccgtgccgctgccggtccgggtgatctgcgaactcctcggcgtaccggccggggaccaggacaccttccacgcctggtcgaacgcgctgctcggggactggcagcaggtggtggagaaggaggccgcgacggtctcgttggtgaactacttcggcgaactcatcgcggtgaagcgggagaatcccgccgacgacctgatcagtgagctgatcgcgatcagcgacggggacagcacgctcaccgagcgcgagatcatcgcgctgagcatcggcattctcagcgcgggccacgagacgaccgccaaccagatcagcatgttcctggtgacgctgctgcacaatcccgaggagctcgacaagctgcgggacaaccgcgaggcgatcccgaaggccgtcgacgagctgctccgcttcgttccgctcaccacgaccggcggcatcattccccggctcaccacggcggaggtggagctgagcggcggccaggtgctgcccgccggcgcggtggtcctgcccgcggtcgccaccgcgaaccgggaccccgaggtgttcgaggacggcgagcggctgaacgtgacgcgggagaacaatccgcatctggccttcggcgccggtatccaccactgcctcggggcgcagctcgcccgcatcgagctccaggaggcgctcggcgcgatcctggaccggatgccccaggtgcggctcgcggtgccggagtcggagctgcggctcaagtccgcgtcgatcatccgcggcctcgagagcctgcccatcacctggtgacatccggcaccgcaccgcggcgaccagcgggcccagcaggttcaccaacctgctgggcccgctgacttctgcctgccggcagaggacagaggacagtgggcgggagccgcagggtaggagtcgccgggcgtgagccgccgggcgggggtcgccgggcgggagccggtggagaggtcaacgggctggagcggccccagggttggagtcgtcgggcggaggccagcgccctgccgggcacgagccggcggccaggagtcggcgggcaggagccgcaggtcggtagctggcggccccgagccgcagggcacgagccgcagggcacgagccgcagggcatgagccgtcggctcccgccctgccccccgctccccctcagcgcgggcacccggcatgcccgcgtgccggcgtaccggtgtatgcgacgggccgtgctccggtgaaggagcacggcccgtcggccggaggaggggcctacgcctcgtggcgcgtcagccactcgtgcacggcggccgccgtgacgtctccgttgccctccagcatcgtgtagtggttgcccggcacgtcgatcgcttcgtggggaagcggccaggcggcctgccactgctcggccggcggctgcacctcgcccggctcgatgccgtagcactccgaggcccgtacgagcagggtcggcgtcgcgatctccttgggctgccagtgctcgaacatgccgaagtacgcggccatcgccgtgagcctcgtcccggtcatctgcccgaagtccttctccagctcgacggccttcgactccatcaccggcacgatgtacgaggtggcgtcgtagccggccatgtagctgtcgatcaggaccaggccccggggcgccagtccccggtcctccagcctggacgtgacctcgtgggcgatccggcctccggaggagcggccggccagcacgaacggttcgccgtcgaccagttcctcgatgagccgcagggcgtactcggccgccgcgtccacgtcggccgcgaccggctgcccggtgacgaagccggggagcatcagcgaccacacgtcacgggttccgcgcaacggcgtggccatgctgaccagttcctggttgctcgcccacacggactgtgaggggaacccgatgatcttcgggtactgcgccccctcaccgagccggacgaggctcgggccgcccttgacctcctgcgggtcggagaagctcacccgcaggtcgaccgagttccgcagcacgctgtggccgaggtcgagccggcccagctcgttcgagcgccggtacagcgcctccactccgttgatcaccgccaggtcgccgagcgcgtccgcgccacggccgctcccggtgtcctcggccggcccggcggccgcctgccccgccgccggagcggcggccatcggtgccgccggggtgcccagctgctcgctgagttcggcggcgagcgcgaggggcgtcggatggtcgaagacgaccgtggacgcgaggcgcagcccggtgcgctcgttgagccggttgcgcagttcgaccgaggtcagcgagtcgaagcccagctccacgaagccgtggccgtcctcgatcgcctcggcaccggagtgcccgagcacctgcgcgacctcgccgcggatcagctcggccagcagggcctgccgttccgcctggtccgccgcggccagttgctcgtgcaggtgcgaggtggcccgtacgtcggaccgggcggcccgccgctgcggagcgcgcaccaggccgcgcagcagcgggggtacctgctgctcgctcgccgcccgcgccgccgtggtgttcagccgcatcggtacgaggagggcttcctggccggcgccgagggcccggtcgaaggcctccatgccggactcggcggtgaagggggtgaccccgccgcgggccatccgggcgcgttcggcccggccgaggtcgccgcccatgccgccgggctgctcccaccagccccaggcgagggcggtgccgggcagtccggcctcgcggcggtgcgcggcgagggcgtccaggaacgagttcgccgccgcgtagttgccctgcccctggctgccgagcagtccggcggccgaggagaagagcacgaactcccgcagcggggcgtcctgggtcagctcgtgcagatgccaggccgcgtcggccttggcccgcaggacggtgtcgaaccggtccggggtgagcgactcgaccgtgccgtccgccagcacacccgcggtgtgcacgaccgcggtcagcggccggtcggccgggatgtcccgcagcagcacggcgagtgcgtcccggtccgagacgtcgcaggccaggatgcgggtgtcggcgccgagttcggtgagttcggccagcagggcggccgcgccgggcgcgcgctcgccgcggcggccggccagcaccagatgccggacgccgtgtgcggtcacgaggtgacgcgcgaccaccgcgccgagcgctccggtgccgccggtgaccagcacggtgccgtcggggccgaagccaggggcgccgtccgccggtccggtgtgcctggccagccggggcacgcagggcgagccggcgcgcagggcgagttgcggttcaccggtgccgagcgccttgggcagggcccggtaggaggcggggtcgtcgtcgaggtcgatcaggacgatccggtccgggtgctccgactgtgccgtccgcaccaggccccacacggccgaggccgccacgtcctcggtacggtccgtgccggcggccgggacggcgccccgggtcagcagcaacagcttggagcctgtgaggcgttcgtcggcgagccagtgctgaatgacctccagtacccggtgtacggcgtcatgggtggcggcgacgatgccgccctggtccccgccgaagcaggacatcgccaccacggagggggcgggcttgcccgactccacggtgtcgatcagggattgcgggtcgaggtacggcgtcccggtcaggccggcttcgacgagccgcgggcggatctccagcgggtcgaagccgagcatcgcccattcgccggagacctctcgggagccgaggggcaccggggtccacttcaggtcgaacagcgcgtcctggcggggtgcggaggcggtgaactgttccagcgcggggtcccgcatcgtgagcgacccgaccgtggcgatcggcagtcctgactcgtcgttgaccaggacggacacttcgccccggcccaccggagcgaggtggacgcgggcgacggtggcgtgggtggcgtgcagtcgtactccggtccaggcgaacggcatgcctcccttgaccgcctcccggtcgggggtgccgccgaggacgcccagggcgagtggctggagtgcggcgtccagcagggccgggtgcactccgaaaccgctgtcggcgtcgcccgcctcctcggggagccgaacctcggcgtacaggtctccgtccttggtccacagtgcccgcaggccctggaagaccgggccgtaggtgaatccggcctcggccatgtccgggtagaagtcctcgacggcgacggcggtggagccgtcgggcggccataccgtcatcggctccgcgtcgggttccgctcccgtgttctcggcgagtacgccgctggcgtgcctcagccagggctggtcgtcgccttcgccgtcgggcctcgagtgcagggtgatggcgcgccggccggtctcgtcgaggccgccgaccagcacctggacggcgcgaccgccctgctcgcccagcaccagtggtgcctccagggtgagttcctcgatcagctcgcagcccacctgtccgccggcgcgcagcgcgagttccacgaacgcggtacccggcagcagcgcggtgcccagcatcgcgtgatcggtgatccagggctgcgtggccagggagagcctgccggtgaacaggaatccgtccgagtcgggcagcgccactccggcgccgagcagcgggtgtccggtcgccgtcagtccgatgctcgcggggtcgccgctgccggtcgtgcgcgagtccagccagtagcgcttgtgctggaaggcgtaggtgggcagtccgacggtgcgggcgccggtgccggcgaacagcccggaccagtcgaccggggcaccgctcgcgtggatccggccgagcgcgagggtcaggcagtccgcttcggggcgttcggggtgcagtacgggcacgcacacggcgtcggcgccggtgtggtcgagggtctcctcggccatcgcggtcagcgcaccccgcggacccagctcgaggaacctgtccacaccccgcgccagcaccgtcgccacaccatcggcgaaacgaacggcctcccgcacatgccgcacccagtaggcgggagtggtgaactcggcgtccgccatcccacccgtcacattcgacaccaccgggatacgcggcggacggaactccaccgcggcgagcgtctccgcgaactccgccagcatcggctccatccgcgcggagtggaaggcgtgactgaccgccaactgcttggtccgcctgccctgttcagcaaacgcttgggcgagcgcggtcaccggctcctcatcaccggacagcaccagcgaacggggcccgttcaccgcagccaccgacacacccccgggaagcaccggcagctcgtcctcggccgcctcgacagcgaccatcgcaccgccctccggcagcgcctgcatcaaccggccccgcgccgccacgatccggcacgcatccgccagcgaccacacccccgccacatacgccgccgccagctcaccgatcgaatgccccagcagcacatccgcccgcacaccccacgaacccaccagctcgaacagcgccacctccaacgcgaacaaaccggcctgcgtgaacaccgtccggtccaacgccggcgcatcggtgaacacgacctccttcaccggccgctccagcaacagatccaactgcgcacacaccccgtcgaacgcagccgcgaacaccgggaaacgctcgtacagctcacgccccataccaagccgctgcgcaccctgaccggtgaacaggaacgccgtcccgccctccccggccacaccccgcaccatccccgccgcgcccgcaccctccgccaacgcggccaactggaccaggaagtcctcccgatcccgccccgtcagaacagcccggtgctccagacccgcacgcgtcaccgccaacgacagacccacgtcggccggccgcagatcgctcccccgtacgtggtcggcaagccgtcgggcctgcgcccgcaacgcctcctccgaccgcgccgacaccacccacggcaccagcaacccgtcaaccgcagacaccggcgtccgttcctcgaccgacggcgcctgctccagaatcacgtgcgcgttcgtgccgctgatcccgaacgaggacacgcccgcccggcgcggcccgtcggtctccggccactcccgcccctccgtcagcagctccaccgcgcccgcggaccagtccacctcgggggtcggctcgtccacgtgcagggtcttgggcaacaggccgttgcgcagggccagtacggacttgatgacaccggcgacaccggcggcgtactgggtgtggccgatgttcgacttcaccgaacccagccacagcggacggtccgccggacggtcctgaccgtacgtcgccagcaacgcctgtgcctcgatcgggtcgccgagcgacgtccccgtgccgtgcgcctccaccatgtccacgtccgccgccgacaacccggccgaagcgagcgcctgccggatcacccgctgctgcgacggaccgttcggcgccgtcagaccgttcgacgcaccgtccgagttcaccgccgaaccccgcaccaccgccagcaccggacgcccgtcccgcaccgcgtccgaaagccgctgcacggccagcatcccgacaccctcgccccagcccgtgccgtcggcaccggcggcgaacgccttgcaccggccgtctcccgcgagaccgccctgccgcgagaactcgacgaaggctcccggcgtggccatgacggtcacaccgccgaccagcgccaggtcgcactcgccgccccgcagcgcctgccctgccaggtgcaggctgaccagcgaggaggagcacgcggtgtcgaccgtgacggccgggccctccaggcccagggcataggcgacccggcccgacatcacgctgcccgacgccccggtgagggcgtaaccgccgcctgcctcggacgagttcatcaggacggtcgtgtactcctgcggggtgccgccgacgaagacgccggtgcggctgccgcgcaggccgaccggatcgaacccggcgcgttccagcgcctcccacgaggtctccagcaacaaccgctgctgcggatccatcgccagtgcctcacgcggcgagatcccgaagaacgccgcgtcgaagtcgccggcctcggccaggaaggcaccctgccgggctccgccggactcctcgatgaaggcgttcatggccaggccgtgccagcctcggtcggcggggaagtccgtcatctcgtcgcggctgtcgacgagcagacgccagaggtcctcgggaccgcgcaccccgccggggaagcggcaggccatgcccacgatcacgatcgggtcgtcgtcggtcgtccgcaggaccggcagtgccgtctccgtggcgctgtcgaagagcttctcgtgcaggtgcccggcgagacgctgcggtgtggggtggtcgaagacgagggtggcgggcaggcgcaggccggtggccgtgttcagccggttgcgcagttccatcgcggtcagggagtcgaatccgaggtcccggaacggccgcccggccgtgatgtcgtccgtcgtccggtgggtgagcacggtcgccgcttcggagcggacgagttcgagcagccggtcgtgctgttcgggggcggtgagcccggccagggtctggcgcagggcggagtcggtgccgtcgtcgggcgcgggctcggagtcctcgctcagcgcgcgggcgacttcggggatgtcctcgatcagcgggcggcgccgggcgatggtgtagccgggggtgaagcgcgcccagtccatgtcggtgacggtcagcgccgtctcgtcctgctccagcgcctgtcgcagggccttgatggccagtgccggttccatcgcccgcacaccgcggcgcgccaactgctcctcggtgccgtcggccgccatgccggtggctttccagccgccccacgacacggacgtcgcgaccagaccgcgcgcccgccggttccacgccagcccgtccagataggcgttcgccgcggcgtacgcaccggttcccgcgctgccccacacggcggcgccggaggagaacaggacgaacgcctccagggtcagctccgcggtcagggcgtcgaggttgcgggcgccccgcgtcttggcggaaaggaccgtctcgtagtgctcgggggtggcggtggcgagttccgcgtaaccggatacgccggcggtgtggaagacggcggtgagggggtgctccgccgggatgccggcgatcacgtggccgagggcgtcgcggtcgctcacgtcgcacgcggcgaacgtcacctccgcacccaaaccgcccaactccgtggccagttcggcagcaccttctgcctgctcgccactacggctgaccagcagcagacgctcggcgccctccttcgccagccaacgggccagatgcgcaccgatgccaccggtgccgccggtgatcagcaccgtgccgtgagggttccagtcgcgtacgggtgccgggttcgcacccagcggagcccgcaccagacgccgggcatacgcacccgacgaccgcaccgctacctgatcctcaccctcccccgccgccaacacggcagtcagcccggaagcaacccgctcgtcccacacccccggcacatcgaccagaccaccccaactgcccggctgctccagaccggccacctgacccagcgcccacacctgcgtctgcaccgggtgcaccacatcctccgcacccaccgacgcggcaccctgcgtcaacacccacaacggcgcctcgaccccggcatccgccaaagcctggacgagcgtcaccgtcgcgacaggcgcggcctcctcatcccaacccaacagcgacaccacacccgacacctcaccggctccggtaaggcgcccggccagagcctcacggccctcctccgcctcccacgccagtacgacgacctcggcgccggccgcctccagcgcccgccggacctcctcgaccggccccgcgccacccggcgtcaccaccagccacgtccccgacaaccggcccaccgacggcaccgtcaccgaacgccacaccgtccgataccgccacgaatccagcaccgaccgctcctgacgcccccggcgccaagccgacaacgccgggaccaccggctcccacacctcaggctccgcgccgtcgacgagcgcggccatgccttggaggtccgcgttctccaccgcgccccagaaggccgcgtccaccggatcgacgacgccgtccgcaccgggcgccaccacgtcctcgatccagtagcgctcgtgctggaaggcgtacgtcggcagatcgacccggcgcaccggcatcccggcgaacagcaccgaccagtcgacgggagcgcccgccacgtaagcctccgcgagcgacgtcaggaagcggtccgcaccgccctcgtcacggcgcagcgaccccacagcggtaccggtgccgaacacgccttcctgggtttcctggatcgccacggtcagtacggggtgggggctggactcgacgaagacctggtattcctgttcggcgagcagccgcaccaccggctcgaaccggacccgctcccgcagattcgtcacccagtaccgcgcgtcgagcccggaggtgtccagccgctccccggtcaccgtcgagtagaaggcgacggcggacgacttgggccggatgtcggcgagttcggcgagcaggtcgtcgttgagggcatccacctgcgcggagtgggaggcgtagtccaccgcgatacgacgggcccgcacccccgactcctcacattccgcgaggagttcgtcgagtgcgtcgggctcaccggagacgacggcggagccgggcccgttgacggccgcgacaccgatccggccctcgaaccgggcgagacgctcctcgacgccctccaccggcagcgcaacggacaccatcccgcccttgccggacagcttctccagcaccagccgcgaccgcacggccaccacccgcgccccatcctccagcgacagaccacccgccacacacgccgcagcgacctcaccctgcgaatgccccacgaccgcggccggctccaccccgaacgaacgccacaccgccgccagcgacaccatcaccgcccacagcaccggctgcaccacatccacccgggaccacaacggatcccccgcgtcccggaacaccacattcctcagcgaccagtcgacgtacggactcagcgcctggccgcactcctccatccgcgcacggaacaccggcgaggcgtcccacaaatcccgccccatccccacccactgcgacccctgacccgggaacacgaacaccacaccggttccggcgtcgccggttccccggaccaggccgggcacgtcgagtccgtccgcgagggcggtgagtccggtgggccggtctccgctacgtgcgccctgtccggcgaacagcaccgcgcgatgcgcgagtttcgaccggctcgccaggagtgagtgggccacgtccgcggttccgaggccggggtgggcgtcgaggtgtgcctgaagtcgtccggcctgcgcccgcagggccgcctccgtctgcccggagatcagccacggcacggtggcggggctcgtggtgaggggcggctccggcgcgtcgaccggctgcggctcggcggagtcctcctcgggggcctgctcgaggatcacgtgggcgttcgtgccgctgataccgaacgaggacacgcccgcccggcgcggaccgcccgtctcgggccactcccgcccctccgtcagcagctccaccgcacccgccgaccagtccacctgggtgctgggcttcccgacgtgcagggtcttgggcagtacgccgttccgcagcgcgagcacggtcttgatcacaccggcgacaccggagacggcctgggtgtgcgcgatgttcgacttgagcgagccgagccagagcggccggccgtcgtgccggtcctggccgtacgtggccagcagcgcctgtgcctcgatcgggtcgccgagcgacgtccccgtgccgtgcgcctccaccatgtccacgtccgccagcgccagtccggcgttggcgaccgcctgccggatcacccgctgctgcgagggaccgttcggcgcgctcagaccgttcgacgcgccgtcctggttcaccgccgacccgcggatcaccgccaggacggggtgaccgttgcgccgcgcgtccgcaaggcgttccagcaggacgacggcggcgccctcgccccagccgatcccgtccgcgtcgtcggagaaggccttgcaccggccgtccgcggccaggccgcgctgccgggcgaaggtcacgaacgccgaggaggtggccatgaccgcgacgccgccggccagtgccagtgagcagtccccctggcggagtgactgagcggcggagtgcagggcgaccagcgaggacgagcacgccgtgtcgaccgtgagtgcggggccctccagaccgagtacgtaggacacccggccggacatcacgctcgccgagccgcccgtgatcgcgtatccctggtcggtcggcgagttcatcagcttgaccgtgtgctcgatggccgtaccgccgacgaacacccccgttcggctgccccgcagcgtgtgcgggtcgatgcccgcccgttccagcgcctcccacgacgtttccaggagcagccgctgctgcgggtccatggtcagcgcctcacgcggcgagatcccgaagaagccggcgtcgaagtcgcccgcgccgcgcaggaacgccccttcccgggtgtacgtcgtccccggccggtcggggtcgctgtcgaagagcgaggagaggtcccagccccggtcgtcggggaatccgctcaccccgtcggcaccgtccatcaccatctgccacagctgctcaggtgagtcgacgccgccgggcagccggcaggccattcccacgacggcgagcggttcccgcgcccggtcctggctgtcctggagctgctgtcgagtctgttgcagttcggccgtgactcggcgcagataggtacggagtttgtcctcggtcatcgtgaaaccccactctggagcggttgaaagcccgacagatgcctgctcgtccgcctgatcaggacacgcctaggtcgcggtcgatgaagtcgaagatctcgtcgtccgtcgcggcttcgagatcggtggtgtcctgctcggcggctccggtgccggtgccgagctgggtgatgaggtcgcggagatggtcgacgatgtcctcgcgggcccgggcatcgggtgcgacgctgttcagcgcctcgccgatccgggtcagctcacgccggatgtcgaggacgtcggcgatgccctgctgcccgtcctgggccagcccggcgcggaggtgttcggcgatgcgctgcgggttggggtggtcgaagacgagcgtggccggcagccgcagtccggtggccttggacagccggttgcgcaggtccatcgcggtcagcgagtcgaagccgagttccttgaacggcctggtcggcgtgatctccgccgtcgacccgtgcgccagcacctgggccgcctcgccgcgcaccagccccagcagcgtggcctgccgctcggggtcggtcagcccggccagacgcttgcgcagatccgcgccggccgccccgtcctccgggccgtcctcgatctcctcggcgtcacgcagtacctgtgccgcctcggggatgtcctcgatgagcgggcggcgccgggccatcgcgtatcccggagtgaacagcgcccagtccatgtcggtcaccgtcaccgacacctcgtcctgctccagcgcctgccgcaacgcctgcaccgccagcaccggatccagcagccgcacaccccgacgcgacaactgctccgccgtgtcccccaccgccatcgccgtcgcctgccaaccgccccacgacaccgacgtccccgccacaccacgcgcccgccgcaaccgcaccagaccgtccagataaccgcccgcggccgcattcgcaccattactgccactgccccacaccgcagccccggaggagaacaccacgaacgcctccaactccacaccgagctcggcggtcaactcgtccagatgacgagcgcccgcgatcctggcggcggtctgcgtgtcgaggtcggtcacgtcgaggtcggccagcggtccgtgaccggcgactccggcggtgtggaagacggcggtgagggggtgctccgccgggatgccggcgatcacgtgggcgagggcgtcgcggtcggtcacgtcgcacgcggcgaacgtcacctccgcacccaacccgcccagttccgcggccagttcggcagcaccctcggcccgctcaccactacggctgacgagcagcagacgctcggcgccctccttcgccagccagcgcgccagatgcgcaccgatgccaccggtgccgccggtgatcagcaccgtgccatgggggttccagtcgcgtacgggtgccggattcgcacccagcggagcccgcaccagacgccgcgcatacgcacccgacgaccgcaccgctacctgatcctcaccctcccccgccgccaacacaccagcaacctgagaggccacccgctcgtcccacacctccggcacatcgaccagaccaccccaactgcccggctgctccagaccgacgatctgccccagcgcccacacctgcgtctgcaccggacggatctcatcgcccgagtccacggacgcggctccgcgggtcaccacccacagaggggccgccgactcgatgtcgccatgggcctggatgagcgtcagtgtcgaggcgaccgcggtgtgttcgtcccaggcgagcagcgagaccacgcccgccgcctcgggagtcccggcgagccgttcggccagctccgcccggtccgtccccgcctcgatcgccaggaccacgacctcggcaccggcgccggcgagggtccgctccatccgctcggtcggcgcaccgtcgctcggggcgaccaccagccacgtgcccgacagccgtgccgagaggggccgatcgttcgtgcgccattcggtgcggtagcgccacgagtcgagtgtcgtctgcttccggcggcccttgcgccaggccgacagcgcgggcagccaggcctccgcggcggcggccgggtcgggcccggtgccgccggatgtgtcgagcacctcggtgagatcggcgagatcctcacgttccacggcatcccagaacgcggcgtccatcgcgtccgccgaggcctcctggatctcgcctccgacggagacgccttcgagccagtagcgctggtgctggaaggcgtaggtcggcaggtcgacccggcgggccccggtgccggcgaacagcaccgaccagtcgacgggcgcgcccgccacgtaggcctcggcgagcgaggtcaggagacggtccgcgccaccgtcgtcacgccgcaacgaccccaccgtcaccacagcccggtccgcgacctcaccggtctcggccaccgccatcgtcaacaccggatgcggactcgactcgacgaagaccgaactccccttctccgccaacagccgcaccaccggctcgaaccgcacccgctcccgcagattcgtcacccagtaccgcgcgtccagaccggacgtgtccagccggtcgccggtcaccgtggagtagaaggcgaccgtggacgacttgggccggatgtcggcgagttcggcgagcaggtcgtcgttgagggcgtcgacctgcgcggagtgggaggcgtagtccaccgcgatacgacgggcccgcacccccgactcctcacactccgcgaggagttcgtcgagggcgtcgggctcccccgagaccaccaccgaggtgggcccgttcaccgccgcgacaccgatccggccctcgaaccgggcgagacgctcctcgacgccctccaccggcagcgcaacggacaccatcccgcccttgccggacagcttctccagcaccagccgcgaccgcaccgccaccacccgcgccccgtcctccagcgacagaccaccggccacgcacgccgcagcgacctcaccctgcgaatgcccgaccaccgcagccgggtccaccccgaacgaacgccacaccgccgccagcgacaccatcaccgcccacaacaccggctgcaccacatccacccgggaccacaacggatcccccgcgtcccggaacaccacatccctcagcgaccagtccaccaacggcgacaacgcccgctcacacgccaccatcgactcggcgaacaccggcgagacatcccacaaatcccgccccatccccacccactgcgacccctgccccgggaacacgaacaccacccggccaccggcggcggtggtgcccgacacgacgccggcgtccggctcccgcgcggcgaccgagcgcaaacggtcgagcaggccggccgcgtcgccgccgagcaccaccgcacggtgttccaggttcgctcgcgtcgtcgccagcgagaacgccacgtcggtgacgtcgaggcccggctcgcgctccaccaggccgcccaggcgcccggcctggccgcacagggcgccgctcgaccggcccgagaacacccacgggacgaccggcgtcaccagtgcgggtgctgccggggccgcctcgtcgggcgcggccggtgtctcctcggcggcgggcgcctcctcgatgatcacgtgggcgttcgtgccgctgatgccgaacgaggacacgcccgcccggcgcggacgctccccctgcggccactcccgcgcctgggtcagcagctccaccgcaccggcggaccagtccaccttgggggtcggttcgtccacgttcagggtcttgggcaacaggccgttgcgcagggccagtacggacttgatgacgcccgcgacaccggccgcggcacccgtgtgcccgatgttggacttcacggagccgagccacagcggccggtcggccggtcgctcctgaccgtacgtggccagcagcgcctgggcctcgatcgggtcgcccagcgtcgtccccgtaccgtgcgcctccaccatgtccacgtccgccagcgccagtccggcgttggcgaccgcctgccggatcacccgctgctgcgagggaccgttcggcgcgctcagaccgttcgacgcaccgtcctggttgatcgcgctgccacggatgacggcgagcacttcatgaccgttgcggcgcgcgtccgagagccgctcgacgaccaccatgccgacgccctcgccccagccgatgccgtcggcggcggccgcgaaggccttggtgcggccgtccaccgagagtccgcccagcgtgtcgaactccgcgaacgcgcccggggtggccatcagaccgacgccgccggtcagggcgagcgagcactcaccgccgcgcagcgcctgggcggcgaggtgcagggcgaccagcgaggacgagcacgccgtgtccaccgtcaccgcgggcccctccaggccgagggtgtaggagatgcgcccggacatgacgctgccggaggaaccggtgacggcgtagccctggctggccggcgagttcatcaggagcgcgccgtactcgacggccgtaccgccgacgaagacgccggtgtcgctgccccgcagtgagtgcggatcgatgccggtgcgctccacggcctcccacgacgcttcgaggagcagccgctgctgcgggtccatcgccatcgcctcacgcggcgagatcccgaagaagccggcgtcgaagtcgcccgcctcgtgcagaaatccggcacggcggaggctggcgaggttccaccggtcccagccgcggtaggaggggaagtcggacatcccgtccttgttctccaccacgacctgccacaggtcctccggcgaggagactccgcccgagtagcggcaggccatgccaacgatggcgaggggttcgtcggcatcggcccgtacgacgtcggcggccgggacgaggtccggcccggcgccgatcagttcggtgcgcaggtgggcggcgagctgccgcgggttggggtagtcgaagacgagggtcgcgggcagccgcagaccggtggcggtgttcagcaggttgcgcagttccatcgcggtcagcgagtcgaacccgagttccttgaacggccgctccggagtgatctcggccgtggaggagtgggccaggatgcgggccgcctcgccgcgcaccaggtccagcagcagatcgagctgctcggcctggccgagcgccgcgagctccgtccggagggccgagcccgccgagtcgtcaccgagcacgtcggcggagtcctcgctcaggacgcgggcgacttcggggatgtcctcgatcaggggacggcgccgggccatcgtgtagccgggggtgaagcgttcccagtccatgtcggtgaccgtcagcgcggtctcgtcctgctccagcgcctgtcgcagggcctcgacggcccgtgccgggtccatcggacggacgccgcggcgcgcgagctgctcggcggtgtcgtcggtggccatgccggtggccttccagccgccccacgacacggaggtcgcggcgaggccgcgggcccggcggtcccatgcgagtccgtccaggtacgcgttggccgcggcgtagccgccgttgccggcgctgccccagatcgcggctccggaggagaacaccacgaaggcgtccagttcgaggccgcgttcggtggtgagctcgtccaggtgacgggcgccgagggtcttggcggccatctgtgcgtccaggtcggcgaggtcgagttcccgtacggtgccgtagctggcgactccggcggtgtggaagacggcggtgggcgggtgctcggcgatcacgtgggcgagggcgtcgcggtcggtcacgtcgcacgcggcgaacgtcacctccgcgcccaagccgcccagttccgcggccagttcggcagcaccctcggcccgctcaccactacggctgacgagcagcagacgctcggcgccctccttcgccagccagcgcgccagatgcgcaccgatgccaccggtgccgccggtgatcagcaccgtgccatgagggttccagtcgcgtacgggtgccgggttcgcgcccagcggagcccgcaccagacgacgggcatacgcacccgacgaccgcaccgctacctgatcctcaccctcccccgccgccaacacaccagcgaacccggaagcaacccgctcgtcccacacctccggcacatcgaccagaccgccccaactacccggctgctccagaccgacgatctgccccagcgcccacacctgcgtctgcaccggacggatcacatcgcccgaccccaccgaggcggcgccatgcgtcaggacccacaacggcgcctcaaccccggcatccgccaagccctgaaccaacgtcactgtcgcggcgggtgcggccttctcgtcccagcccagcagcgacaccacaccggacagttcaccggcttcggccaggcgcccggccagcgcctcgcggccctcctccgtctcccacgccagtacgacgacctcggcgccggcgccgaccagggcctcctcgatccgctcggccggagcaccttcgccgggggcgaccaccagccacgtgcccgacagccggcccgccgacggcaccgtcaccgaacgccacaccgtccggtaccgccacgaatccagcaccgaccgctcctgacgccccttgcgccaagccgacaacgccgagagcaccggctcccacgcctccgggtccgcaccgtcgaccagcgcggccacgccctgcacatcggcgcgctccaccgcaccccagaaggccgcgtccaccgggtcgacgacgccgtccgtaccgggcgcggccgcgtcctcgagccagtagcgctggtgctggaaggcgtacgtcggcagcccgatccggcgggttccggtgccggcgaacagcaccgaccagtcgacgggagcaccggcgacgtgtgcctcggcgagtgacgtcaggagacggtccgcgccaccgtcgtcacggcgcagcgaccccaccgtcaccacagcccggtccgcgacctcaccggtctcggccaccgccatgttgagtacggggtgcggactggcttccacgaagagtccgtgcgcctggtcggcgagcagccgcaccaccggctcgaaccggacccgctcccgcagattcgtcacccagtaccgggcgtccagaccggacgtgtccagccgccccccggtcaccgtggaatagaaggcgaccgtggacgacttcggccggatgccggcgagttcggcgagcaggtcgtcgttgagggcatccacctgcgcggagtgcgaggcgtagtccaccgcgatacgacgggcccgcacccccgacccctcacactccgcaaggagctcatccagtgcctcgggctcccccgagaccaccaccgaggtgggcccgttcaccgccgcgacaccgatccggccctcgaaccgggcgagacgctcctcgacgccctccaccggcagcgcaacggacaccatcccgcccttaccggacagcttctccagcaccagccgcgaccgcacggccaccacccgcgccccgtcctccagcgacagaccacccgccacacacgccgcagcaacctcaccctgcgaatgcccgaccaccgcagccggctccaccccgaacgaacgccacaccgccgccagcgacaccatcaccgcccacaacaccggctgcaccacatccacccgagaccacaacggatcccccgcgtcccggaacaccacatccctcaacgaccagtccaccaacggcgacaacgcccgctcacacgccaccatcgactcggcgaacaccggcgagacatcccacaaatcccgccccatccccacccactgcgacccctgacccgggaacacgaacaccacaccggtgtccgtgccgttgccacggatcacggccggggagatggcggcttcggcgacggcgttcagcccgcgcgtgagttcctccgaggtgctgccgagtaccaccgcacggtgttccaggttcgctcgcgtcgtcgccagcgagaagcccacatccagcggggccgcctcgggacgcccggccaggtgctcggccagccgtgccgcctgagcccgcaacgccgcctcggtacgccccgacaccagccacggcaccggcccgctcaacgccggacgcccctccgcccccggcgcctccgcggaccccggcacctccgcaccctccggctccggcgcctgctccagaatcacgtgcgcgttcgtgccactgatcccgaacgacgacacacccgcccggcgcggacgctccgcatccggccactcccgcgcctgcgtcaacagctccaccgcacccgccgaccagtccacctgcggcgtcggctcgtccacatgcagcgtcttcggcaacaggccgttgcgcagggccagtacggccttgatgacgcccgccacgccggccgcggcacccgtgtgcccgaagttggacttcacggagccgagccacagcggccggtcggccggacggtcctgcccataggtggccagcagcgcctgggcctcgatcgggtcgcccagcgtcgtccccgtaccgtgcgcctccaccatgtccacgtcggcggccgacagaccggcgttcgccagcgcctgccggatcacccgctgctgcgaaggcccgttcggcgcgctcagaccgttcgacgcgccgtcctggttgatcgcgctgccacggatgacggcgagcacttcgtgaccgttgcggcgcgcgtccgagagccgctcgacgaccaccatgccgacgccctcgccccagccggtgccgtccgcggatgccgcgaaggccttgcagcggccgtcgcccgccataccgcccaaggtgtcgaactccgcgaacgcgcccggcgtggccatgatggtcacaccgccggccagggccagctcgcactcgccgttgttcagggactgagcggctaggtgcagggcgaccagcgaggacgagcacgccgtgtccaccgtcaccgcgggaccctccaggcccagcacgtacgacacccggcccgacatcacgctgccgagcgcaccggtcatgccgtagccgccgccggcctcggccgagcccatcagcaccgcggggtagtcctgcgggccgccgccgacgaacactccggtggagctgcctcgcagcgaccacggatcgataccggcctgctccaccgcctcccacgacgtctcgaggagcagccgctgctgcgggtccatcgacgccgcctcacgcggcgagatcccgaagaaggcggcgtcgaactcccctgcctcgtgcaggaaaccggcctggccgaccgcgggtgcgccccagcggtcccagccgcgatcggtggggaagtcggacagttcgtcgcggccttcgacgatcagccgccacaggtcgtcggcgtcgcgcacgccaccggggtagcggcaggccatgccgacgatcgcgagcggttcgtcgtccaccggccggacggccggtgccgcgggtccggctgtccccggcagaccgtccaccagctcggtacgcagcagggccgccagctgttccgggttgggatagtcgaagacgagcgtggccggcagtcgcagtccggtggccttggacagccggttgcgcaggtccatcgcggtcagcgagtcgaagccgagttccttgaacggcctggtcggcgtgatctccgccgtcgacccgtgcgccagcacctgggccgcctcgccgcgcaccagccccagcagcgtggcctgccgctcggtctccgtcatcgcggcgagccgctcccgcagacccacgcctgccgagtccagggtctccccggccccggccgccccactcagtgcctcaccggcttcggggatgtcctcgatgagcgggcggcgccgggccatcgcgtatcccggagtgaacagcgcccagtccatgtcggtcaccgtcaccgacacctcgtcctgctccagcacctgccgcaacgcctgcaccgccagcaccggatccagcagccgcacaccccgacgcgacaactgctccgccgtgtcccccaccgccatcgccgtcgcctgccaaccgccccacgacaccgacgtccccgccacaccacgcgcccgccgccgccgcaccagaccgtccagataaccgcccgcggccgcattcgcaccattactgccactgccccacaccgcagccccggaggagaacaccacgaacgcctccaactccacaccgagctcggcggtcaactcgtccagatgacgagcgccgagaacgcgggcggagagcacgtcggtgaagtgctcgggggtggcggtggcgagttccgcgtaaccggatataccggcggtgtggaagacggcggtgagggggtgctccgccgggatgccggcgatcacgtgggcgagggcgtcgcggtcgctcacgtcgcacgcggcgaacgtcacctccgcgcccaagccgcccaactccgtggccagttcggcagcaccttctgcctgctcgccactacggctgaccagcagcagacgctcggcgccctccttcgccagccaacgggccagatgcgcaccaataccgccggtaccacccgtgatcagcaccgtgccatgggggttccagtcgcgtacgggtgccgggttcgcacccagcggagcccgcaccagacgacgggcatacgcacccgacgaccgcaccgctacctgatcctcaccctcccccgccgccaacacggcagtcagcccggaagcaacccgctcgtcccacacccccggcacatcgaccagaccaccccaactacccggctgctccagaccggccacctgacccagcgcccacacctgcgtctgcaccgggtgcaccacatcctccgcacccaccgacgcggcaccctgcgtcaacacccacaacggcgcctcgaccccggcatccgccaaagcctggacgagcgtcaccgtcgcgacaggcgcggcctcctcatcccagcccaacagcgacaccacacccgacacctcaccggctccggtaaggcgcccggccagagcctcacggccctcctccgcctcccacgccagtacgacggcctcggcgccgaccgcctccagcgcccgccggacctcctcgaccggccccgcgccccccggcgtcaccaccagccacgtccccgacaaccggcccaccgacggcaccgtcaccgaacgccacaccgtccgataccgccacgaatccagcaccgaccgctcctgacgcccccggcgccaagccgacaacgccgagagcaccggctcccacacctcaggctccgcaccgtccaccagcgcggccacgccctgcacatcggcgcgctccaccgcaccccagaacgcggcatccgccgggtcgtcggagaaaccgctctggccgggcagcgcaacgtcgtcgagccagtagcgctggtgctggaacgcgtaggtcggcagatcgacccggcgcaccggcatcccggcgaacagcaccgaccagtcgacgggagcgcccgccacgtaggcctccgcgagcgacgtcaggaagcggtccgcgccaccgtcgtcacgccgcaacgaccccactgtcaccacagcccggtccgcgacctcaccggtctcggccaccgccatcgtcaacaccggatgcggactcgactcgacgaagaccgaactccccttctccgccaacagccgcaccaccggctcgaaccgcacccgctcccgcagattcgtcacccagtaccgcgcgtccagaccggacgtgtccagccgctcacccgtcaccgtcgagtagaacgccaccgacgacgaccggggctgaatgtccgcgagctccctcaacagatcctcgttgagggcatccacctgcgcggagtgcgaggcgtaatccaccgcgatacgacgggcccgtacccctgactcctcacattccgcaaggagttcatccagtgcgtcgggctcaccggagacgacgacggagccgggcccgttgacggccgcgacaccgatccggccctcgaaccgggcgagacgctcctcgacctccccgaccggcagcgcaacggacaccatgccgcccttgccggacagcttctccagcaccagccgcgacctcacggccaccacccgcgccccgtcctccagcgacagcccacccgccacacacgccgcagcgacctcaccctgcgaatgccccacgacagcggcaggctccaccccgaacgaacgccacaccgccgccagcgacaccatcaccgcccacaacaccggctgcaccacatccacccgggaccaggacggagtgccctcctcctgccgcaccacggcgagcagcgaccagtcgacgtgcggggccagtgcctccccgcactcctccatccgtgcgcggaacaccggtgcggagtccagcagctccgccgccatccccacccactgcgacccctgacccgggaacacgaacacgacgccgctgtcggcggtggctcggccggccacgacacccgcgacgcccgcaccgtccccgctgtcggcgaccgaccgcagtccggcgatcagttcgtcgcggtcggcgctcaccaccaccgcccgctgttcgaaggccgaacgggtccgcgccagcgagaagcccacatccagcggggtcgcctcgggacgcccggccaggtgctcggccagccgtgccgcctgagcccgcaacgccgcctcggtacgccccgacaccagccacggcaccggcccgctcaacgccggacgcccctccgcccccggcgcctccgcggactccggtacctccgcgccctccggctccggcgcctgttccaggatcacgtgcgcgttcgtgccactgatgccgaacgaggacacacccgcccgtcgcgggccgtccgtctccggccactcccgcgcctgcgtcaacagctccaccgcacccgccgaccagtccacctgcggcgtcggctcgtccacatgcagcgtcttcggcaacaggccgtgctggagcgagagaacggccttgatcactccggagacgccggccgcggcctgggtgtgtccgatgttggacttcagggtgccgagccacagcggccggtcggccgggcggtcctggccgtaggtcgcgagcagcgcttcggcctcgatcgggtcgcccagcgtcgtccccgtgccgtgcgcctccaccatgtccacgtcggcggccgacagaccggcgttcgccagcgcctgccggatcacccgctgctgcgaaggaccgttcggcgcgctcagaccgttcgacgcgccgtcctggttcaccgccgacccgcggatcaccgccaggacggggtgaccgtcccggcgcgcgtcggtcaggcgctggacggcgagtacgcccgccccttcgccccagccggtgccgtcggcggacgcggcgaaggccttgcagcggccgtcgcccgccgatccgccggtcgccgagaactccgcgaagatcgacggggtgacgagcaccagcacgccgccggccagcgcgagatcgcattcgccggtgcgcagcgacttgacggcgaggtgcagggcgaccagcgaggacgagcacgccgtgtccaccgtgaccgcgggaccctccaggcccagcacgtaggagatccggccggacagcacactgccgggggcgcccgtcagcgcgtaaccgcccgctccctcggccgagttcatcaccagcgcgccgtactcctgcggggctccgccgatgaacacgccggtgcggcttcccttgagcgtggcggggtcgatgccggcccgctccagtgcctcccacgacgtttccaggagcagccgctgctgcgggtccatcgccatcgcctcacgcggcgagatgcggaagaaggcggggtcgaagtcgccggcgtcgtggaggaaggcacccgtacgggcggtggggatgtcccagcggtcccagccgcggtcggtggggaagcccgacatggcgtcgcggccttccgtgatcagccgccacaggtcctcggtgtcgcggacaccgcccgggtagcggcagccgatgcccacgatggcgagaggttccgcggaggccgtggtgagccgctggttctgctgccgaagccgctcgttctccagcagcgaggcccgcagcgcgtcgacgacctccgacatggaactgttcatgctcaactcccactcaagtgtttcgtcatcgcgcaaggacaggcccttttgcaggctatggggccgggagctggatcccggccccagttctggaccgcgaacacccctaagttctgggtggggtggcccgcggcggaggcctccgtcaggacagcccgaactcgtcgtcgagcagggacacgagctcctccgcgctcaccgagtcgaggtcggaaccgtccgccgcttcctcgtccccggcctcttccagcgtcgccaggagcacccgtagccgggtcgccatcgctccgcggtcgtcggcgtccgggttcatcgaccggacggcgctctccaggccgcgcagggcgagcagggccgggtcggtggcgccggccgtgtccagccgcatgccggtcagcagatgggcggcgaggacccgggtgttggggtggtcgaagacgagggtcgcggagagccgtacgccggtgagggtgctgaggcggttgcggaggtcgacggccatcagggagtcgaagccgaggctcttgaacgccttggtgaccggtacggcgtccgccgacggcagggcgagcaccgaggcgacctcggcgcggatgaggttctccagggtggtggtccggtcgtcctgcggcagggggcgcagtcggtcgcgcaggccggaggggccgtgggcgagtccgctggtgcggcgtcgtggcgccgggaccagggcgcgcagggcgccgggcagggcggcccggtcggcggtggacaggccgccgggttcgaagcggaagggcagcagctccggttcgccggtggcgtgggcggcgtcgaagagggccaggccgtcgtcgggggccagcggcagcatgcccgcgcgggcgatgcgccgcaggtcggcggcggccagctgggcggtcatgccggcgctgctctcccaggggccccaggcgagggagagggcgggcaggccgtcggcccgtcgccgtcggcacagggcgtcgaggtaggcgttggcggcggcgtaggcggactgtccgccgccgccgagggcgccggcgagggaggagcagacgacgaaggcgcgcaggccgaggtgtgcggtgaggtcgtgcaggttcaccgccgcgtcgatcttcggcctgaggacgcggtcgacctgttccccggtgagtgtgccgagcagtccgtcgtcgacgacgcccgccgcgtgcaccactgcggccaggggtgcctcctgggggatcgcgtcgagtacggcggccagggcgtcccggtcggccgcgtcacaggcgacgacgcgtacgtcggctcccgcgtcggcgaggtcccggcggagttcggcggtgccgggcgcggcctcgccacggcggccggcgagcaccaggtggcgtacgccgtgctcctggaccaggtgccgggcgagcaggccaccgatcatgccgccggccccggtgatcagggtggtgccgtcggccggccagggccggccctgcggcggggtgtcgacggggtggcgggcgagcctcggtacgagggtcgtgccggcccggatcgcgaactgcgcggcgtccgcggtgtcgccggagtcgccggtgccgtcgaagtcgtcggagtcgtcggtgccgtaaccggaggcctgtacgagcgcctgggcccgggtgaggtccgcgaggccggtgtcggtgtcgaggtcgaccaggagcagccggtccgggtgttccagctgggcgctgcgggccagtccccacaccgcgctctgcgccaggtcccgtacgccttcgccgggtcgggcctcgacggcgccccgggtgcacagcaccagccgtgacttgacgaagtgttcgtcctccacccaggtgcggagggtgtcgagcgccgcgtgcacggccgtacgggccgcgtccgcgtcgaagccggtgggggtgccgggggcgcaggggaacaggacgtggtcgggggccggtccgccttcggcgaggtgccggcgcagggcgtcgaggtccgggtaggggtcgatgtccggggcgtcggtgacggcggggcccaccacggcccagcggaccgcggggtggccggccgcctcgggctccggggcgggggtccagtccatgcggaacagcgacgaggccgcgaccgacgtgcccagctgggcgcgggagacggtgcgcaggctcagtccgccgacggagacgagcggctgtccgtcgccgtcccagagggtggcggccacttcgtcggtgccggggcctgccgcgaggaggatgcggcaggcggtggcgccgggggcgggcgcggacacgttccgccaggagaagggcaggaacgggccgctgtcgcgggcggcggagggcaggaacgcgagggtgtgcagggccgcgtccagcagtgcggggtggacgccgaaggccttggcgtcgtcggtggtctgcgggggcagggcgacctcggcgtagatcccgtcgctgtggcgccaggccgcggtcaggccctggaacaccggtccgtaggcggtgccggtggtggtcaggtccgcgtagaagtcctcgaggcgtacgggttcggcgccgtcgggcggccacacggcgggcggggtggccggctgctcggggggcgggccggcggcgagcagtccctccgcgtgtttggtccactcggtgccggaggctgcacgggagtagaccgcgaccggcctgctttcctcccgggtggtctcgccgacgacgacctggacggtgacgccgccgtgttcgggcaggatcagcgggctgtggacgacgagttcctcgacctcaccggcgtcgaggcggctgcccgcccacagggcgagtacgaggaagccggtgccggggaacagcacggagtccaggatccggtggtcggccagccagggctgggcggccagggagagttcgccggtgaacagggtgtcgccgccggaggccgagccgaccatggcgccgagcagggggtgtccggtgccgtccaggccggccgaggagaggtcaccgcggtcggcggtggactcggcgggccagtaggccgtgcgctggaaggcgtaggtcggcaggtccgcccgccgggcgccggtgccttcgaagaccgcgtcccagtccacggtgacgccgtgcacatgggcgcgggccagtgcggtcaggagggtcgtcggttccgtggcgtcgcgccgcagcagtgcggcgcacaccccggtgggggcggtgtcgaggcaatcctcggccatcgtggtgagcgtcgcgtcgggacccagctccaggaagccggtgacgcccgcgccgacgagggcgtcgaccccgtcggcgaagcggacggtgtgccgggcgtgccgcacccagtagcgcgggtcggcgaactcgtcggcgccgaggacggctccggtgaggttggagacgacggggatgcggggtggagcgaaggacaggcctgcgaccagctcggcgaactcgtcgagcatcggctccatcagcggcgagtggaaggcgtggctgacgccgaggcggcggatccggcggccccgctcggtgaagtgcgcggtgagcgcgtccacggacgcggcggcgccggagagcaccaccgagcgggggccgttgacggcggcgatgtccacggtgtccgcgtgctcgcccaggacggcggtgagggcctcggtggcctcccgctcgtcggcctggaccgcgagcatggctccgcccggcggcagggcctgcatcaggcggccccgggcgaccacgagccccgcggcgtcggcgaggtccagggcaccggccgcgtgggcggccgcgatctcgccgacggagtgcccgaggaggtagtcggggaccacgccccacgacgcgagcagccggaacagggccacttcgagggcgaagagcgcgggctgggtgagcgcggtccggtcgagttcggcggcctcggcggtgaacaccgtctcgcgcagcggcctgccgagcagcgggtcgatgtgcgcgcagacctcgtcgaaggcccgggcgaacgcggggaacgtctcgtacaactcccggcccatgccggggcgttgggcgccctgtccggggaagagcagcgcgaggccgccctcgccggccgtgccgagcagcagtccgtccggggtgcgccccgccgcgaactccgcgagccgggtgagtgcgtcgtcccggtcggtgacgggcagcgcggcccggtgttccagggcggtgcgccgggtggccagggagtgggcgacgtcggtgaccgagtcctccgtccgctgacgcagatgggtcagcagggtcttcgcctgggcgcgcagggcctgttcgtcgtggccggacagcagccacggggtgagcggcagcgcggtggccgccgcgggggcggggtccggctccgcggcctgttcgaggatgacgtgggcgttggtgccgctgaccccgaaggaggacacgccggcccggcgggggcggccggtctccggccacgggcgggtctcggtgagcaggtccacggcgcccgcggtccagtcgacgtgcggggtcggttcgtcgatgtggagggtgcgcggcagtacgccgtggtgcagggcctgcaccatcttgatcactccgccgacgccggcggcggcctggctgtgcccgagattggacttcagggagcccagcagcagcggccggtcctcggtccggtcccggccgtaggtggcgaggatggcctgggcctcgatggggtcgccgagggtggtgccggtgccgtgtgcctcgacggcgtcgacgtcgggggcggtcagcccggaccgttccagcgcctgccggatcacccgctgctgcgacggcccgttgggcgcggtcaggccgttggacgcgccgtcctggttgacggcgctgccgcgcagcacggcgagcacccggtggccgagccggcgggcgtcggagagccgctcgacggcgaggacgccgacgccctccgcccagccggtgccgtcggcaccggcggcgaaggccttgcagcggccgtcgggtgacaggccgccctgcttggcgaagtcgtcgaagaggaacgggctggtcatcaccgcgacgccgccggcgagggcgaggtcgcagtcgccgctccgcagcgcctgggcggccgtgtgcagggcgaccagcgaggacgagcacgccgtgtccaccgtcaccgcgggcccctccaggcccagcacgtaggagacgcgtccggacaccacgctggtggacgcgccggtcacgccgtacccggcgagcgcctgtgagccgcgggggaacaggctcgtgtatccggaggtggccgcgccgacgaagacgccggtacggctgccgcgcagggtgccgggcgcgatcccggcacgttcgagggcctcccaggacgtctcgaggagcagccgctgctgcgggtccatggtcagcgcctcccgcggggagatcccgaagaacgcggcgtcgaactccgcgacacggtcgaggaatccgccctgctgcggcacggagccgtcggcgggtgccccggtgctccagccgcggtcctccgggaagccggagacggcgtcccgctcgccgatgacgaggtcccacagctgctcgggcgaggtgatgccgcccgggtagcggcaggccatgccgacgatgacgaggggttcgtcgtcggtgcgggctaccgcgggcacgggggccgcgggggcggcgggttcggcgagatcaccgaggagttcggcggccaggaagtcggccagctcgctcggcgtcgggtggtcgaagacgacggtgaccggcagccggaagccgacggcgccggtcagccggttgcggaactccacggcggtcaacgagtcgaagccgagctcgcggaacggcgccgtcgagccgaccgcgtcggggtcggagtgcccgagcacggtggcgacatgggagcggaccagctggagcaggatccgcatgcgttcggtgccggtgagcggggtcaggcgctcgcgcagggatccgccgccggtgtccgccggccggcgtccggcgcggcgggcgggcgtgggcaccagcgcccgcatgatgggcggcacccggcccgacgtcccggcgagcgcggcggggttgagtttcgcgggcaccagctgggcgctgccggtgcggcaggccaggtcgaacaccgcgaggccttcgtcgctggtcatcggcacgatgccgccgcggctcaggcgccgcatgtcgcggtcgtcgaggtggcccgacatctcgctgcgctgtgcccagaagccccaggcgagggagagtccgggccgcccgtgggcccgccggtgggcggcgagggcgtcgagcatcacgttggcggcggcgtagttgccctggccgggggcgcccatggtgcccgccatggacgagaacagcacgaaggcgccgaggtcgaggtccttggtgagttcgtgcaggttgagtgcgccggtcaccttgggccgcagtacggccctcgtgcggtcggcggtgagggactcgacgaggccgtcgtccagcgccgccgcggtgtgcagtacggcggtgagggggcgttcggcggggatgtccgcgagcagcgcggcgagttggccgcggtcggcgatgtcgcaggccgcgacggtcacctgggcaccggccgcggtcagttccgcggcgagttcgctcgcgccgggggcgtccgggccgcgccggctggtcagcagcaggctgcccaccccgtgctcggtgaccaggtggcgggcgagcagcgcgccgagcatgccggtgccgccggtgatcaggacggtgccgtgggcggggaagggctcgccggggagggtgagcaccgccttgccgatgagcgcggcctggctcagcgcccggaaggcggcgcgggtgtcgcggatgtcccaggtgttgaggtgcggaggcgcaaggacgccgctctcgaacagctcggcgaggatgcccagcatggcgtggatgcggtcgagcccggcttccggaaggtcgtacgcctggtaggcgacgcccgggtatgcctcggcgacctgtgccgggtcgcgcttgtcggtcttgcccatctccaggaagcggccgccccggggcagcagcctgaggcccgcgtcgacgaactcgccggccaggcagtcgagtacgacgtccatgccgcggccgccggtggactccaggaaccactgctcgaagtcgagggtccgcgagttcgcgaggtgcgcggcgtcgagcccgcaggcgcgcagcgtgtcccacttgccggggctcgccgtgccgtagacctcggcgccgaggtggcgggcgagctggacggccgcgctgccgacgccgccggccgcggcgtggatcagcacggactggccgggccggagtccgccgaggtcgacgagtccgtagtacgcggtcaggtaggcgacggagaccgaggcggcctcctcgaaggtccagccgtcggggatgcggtggacggtgcgttcgtcggcgacggtcaccgggccgaagacctcggtggacaggccgaacacccggtcgccgacgcggtggtgggtgacctcggcgccggtgccggtgacgacaccggcgacttcgccgccgagtccggtcaggccgggcaccaggtcgagggcgacgacgacgtccttgaagttgatgccggcggcgcggacggcgatccgcacctgccggggtccgagcggttcgagtgcctgcgggtacgggaccgccgtgaggccctcgatggtgccgggcctggtgttctccaggcgccaggcgggctccccggccgggggcaggatggtgccggcgggatcccagcgggccaggctcggggtgcgtacctggccttcgcgcagggcgagttgttcctcgccggacgcgagcgccgcgccgagcgccgctcgggacccggcggccgtgtcgaggtcgaggaggccgaagcgtccggggtgttcgttctgcgccgagcgcagcagtccccagactccggcggcggcgaggtcggtcacgtcctcgccggccgtggccgccaccgcgccgcgggtgaccacgacgagccgggtgtcgtcgagccgcccgtcggcgatccactcctggaggagggcgacggtgtcgacgaccggttcgccgacccggtcggtggagccgtcgccggcgaccgggagcagcgcggtgacggcggcgccgtccgcggcgacgagcgcggccagctcctcggtcccggcggcgagcggggtgccgggcagggcgtcgcacagccccagcgggtcggcccccagcacgacgcagcgcggggcgggctcctcggcccggacggtcttccagtcgagccggtacagcgcgtcggcgcgtacggtgctcagcgcggcctcggtcatccggcgtacgacgagggtgtcgaccgagacgaccggtgcgccggcctcgtcggcgagcagcagcgtgatcccgttctcgccgcgccgggacagccgtacgcgcagccgcgagcagccggtcgcgtgcagccgtacgccggtccaggagaacggcatgcccacgccgccgtcgtcgtcgccccaggtgaacatggcgtgcagggccgcgtcgaagagcgccgggtgcaggccgaagcgctcggccgcggagcgctggtcggcgggcagggccacttcggcgtacacctcgccgtcgcggtgccagacccggctcaggccgcggaactcgggcccgtactggtaaccggccgcggccatgcggtcgtacatcccggagatgtccacggcctcggcgccctcgggcggccaggtcccggtgatcccctcgggttcctcgccgggttcggcgacgaggacgccggacgcgtgccgggtccagaccgtgtccgccgaggcgtcgtcggcacgggagtacacgctcaccgcgcgggcccccgtctcgtcggccgcctcgacctgtgcctgcaccacgaccgcgccgctctcgggcaccaccagcggggtgtgcagggtcagttcctcgatccggccgcagccgacctggtcgcccgcgagcacggccagctccacgaagccggtgcccgggaagatcacccggtcggagacgccgtgcccggccagccaggtctgggcgcgcagggagagccggccggtgagcacggcgccgtcgccgtcggccatccggaccagggctccgagcagcgggtggtcgaccgaggacaggccgaccgaaccgacgtcaccggtgcggtcgccggcctcggtccagtaacgggtgcgctggaaggcgtaggtgggcagttccacggtgcgggcgccggtgccggcgaacaccgcgggccagtcgacgcggaccccgccgaggtgcgccttggccagcgaggccgtcatccggccgaggccgccctcgtcgcggcgcagggactccaccacgacgccggacgccccggcggcgtcgacggtctgttcgacgcccatcgccagcaccgggtgcgcgctggactcgacgaacgcgctgtgcccctcggcgagcagcgcgcgcacgaccggttcgaagagcaccggcgcgcgcgtgttgtcgtaccagtagccggcgtccatggcggcggtgtccagccggccgccggtcaccgtcgagtacaggggtacggtcccggtgcgcggcgcgaccggcgccagcaggtcgaggagccgctcgcgcagggggtcgaccagggcgcagtgcgtcggcacggtggcggcgacgatcctggcgcgcacgttgtcgcgggcgcactcggcgatgaactcggcgagggcgtcgtcgtctccggcgaccgcgacgatccggggcccgttgacgccggccacggacagccggtccgcccagcgggtcagtcgctcgcgcacctcgtcggcgggcagggcgacggaggcgacggcgcccttgccgacgagggtctcggccaggagtgcgctgcgcaggcagatcacccgggccgcgtcctgaagggtcagtccgcccgcgacatgggcggccgcgatctcgccctgcgagctgccgacgacggcgtcgggctccaccccgtaggaacgccacagctccgccagcgacaccatcacggtgaagagcacgggctggatgacctcgatgcgttccatcgaggcggcgccgggcttctcgcgcagcacgtcgaggaccttccagtccacgaactcctcgatcgccgccgcacacgcggccgccttcgccgcgaacaccggtgaggtgtcgaggagttcgcgggccatgccggcccactgcgagccctgccccgggaacacgaagacgaccttgccgtcgacgggcggtgagccgcgcagtaccccttcggcggggcggtccgtggcgagcgcgtccagcgcgtcgaggaatccgtcccggtcggcggcgagcacggcggcccggtgctccaggccggtgcgggtgacggcgagggagagggccacgtcggcgtcgctcgcgccgggacgggccagcaggtgctcgcgcagggcacgggcctgcgcgcgcagcgcgggctcaccgcgggcggagagcacccacgggaggagtggcggggcggtcgccccgggcgcctctccgggggtttcctccggtgcttcttcgggcgtttcttcgggagcctgctccaggatcacgtgcgcgttggtgccgctgatgccgaaggacgacaccgcggccaggcggggggtgtcggaggcgggccaggggcgggcctcggtgaggagttcgacggcgcccgaggaccagtcgacgttcggggtgggctcctcggcgtgcagggtcctgggcagcaggccgtgccgcagcgcctgcaccatcttgatcacaccgccgacgccggcggcggcaccgctgtgcccgatgttcgacttcagggagcccagccacagcggccgccccgccgttttggcctgcccgtacgtggccagcagcgcgtccgcctcgatcgggtcgccgaggctggtgccggtgccgtgcgcctcgaccacgtcgacctcggcgggcgacacacccgcgttggccagcgcctgccggatcacccgctgctgcgagggcccgttgggcgcggtgagaccgttggacgcgccgtcctggttgacggcgctgccgcgcagcaccgcgagcacccggtgaccgagccggcgggcgtcggagagccgctcgacggcgaggacgccgacgccctcgctccagcccgcgccgtcggccgccgccgagaacgccttggagcggccgtcgggggccagcgcgcgctgcccggacagggccacgtggaccgcggaggtggacagtgtcgtcgcgccgccggccagggcgaggtcgcactccccgctccgcagcgcctgggcggcgaggtgcagggtcaccagcgaggaggagcaggcggtgtccacggtgacggccgggccctccagacccagcacatacgagatccggccggagagcacgctgttggaggtgccggtggagccgtagctgtccagaccgtccggggcggcggccagcagggtgccgtagtcctgctggttgagtccggcgaagacgcccgtacggctgccgcgcagcgcgtggatgtcgaggccggcgtgttccagcgcctcccaggaggtctccaggagcagtcgctgctgggggtccatggactgcgcctcgcgcggggagatgccgaagaaggccgcgtcgaaggaggcgatgtcctcgacgaacccgcccgcctccgcgtagcaggtgcccgggtggtcggggtcggggtggtggaggccgtccaggtcccagccgcggtcggtggggaaggggccgatcgcgtccgtctcgtcggtgaccagccgccacaggtcctcgggcgaactcaccccgccggggtagcggcaggccatcccgacgatcgcgatcggctcggtgccctgcgactcgatctcggtcagtcgctggcgcgtccggtgcagatccgcgctgacccgcttgagatagtcacgaagctgctgctcgttggccatcggactcagtcctttccgaattccgcgttgatgaagtcgaagagctcttcatccgaggcggaatcgagcttgctggtgatgtcgccgtcgtcggcttcgagttcgtccgcgctccaggcggaggccagccggcgcagccgggccgcgagctgttcgcgggtggcccggtccggtggcgaggtggcgagcgcggcttcgagatggtcgagctgggtgagcgccggcagcggagccccggcgaccgaccgcaggaccttgctctccaggtgctcggcgagcgcggtcgccgtggggtagtcgaagacgagcgcggcggagagctggacgccggtcgcggcgatcaggccgttgcgcagctcgaccgcggtgagcgagtcgaatcccagctcccggaaggggagtttggcgtcgagcggggcgtcggccgcgtagtccagtacggcggccacctgccggtggatcagatccagcagcagctgtcgccgcccgctctcggactgctcggccagctgctgcgcgaaggactgcccggccgcccgcgcaccggccgccgaggccctgcgcaggggtgcgcggaccaggccgcggaagggtgcgggcagggtcgcctcggccgccttcccgcgcagtacggccttgtcgaggcgcatgggtaccaaggtggtcgcgtccgagttccacgccgcgtcgaacagggcgagaccctgccgcggggtgaaggcgaggacgccggcctgggccatccgccgccggtccacgtcggagaggtgcgccgacatgccggccgtggtctcccacaggccccaggcgagcgaggtcgccggcaggtcggccgcgcgcctgcggtgggcgagtgcgtccaggaaggcgttggccgccgcgtagttggcctggcccgcgccgccgaaggtgccgacgcccgaggagaacagcacgaagtgggacagcccgaggtccgcggtcagctcgtgcagatgctgcgccgcctcggccttgggccgcagcacggtgtcgatccggtcgggggtcagggtggtgaggactccgtcgtcgacgactccggcgatgtgtacgacggcggtcacggggtgctcggccggtacgtccgccagcgcgtcggccagggcggcgcggtcggcggtgtcgcaggccgtgaaggtcgcgtcggcgcccgcctcggcaaggactcggcccagttcggccgcgcgcgggtcgtcggggccccgcctgctgagcagcagcaggtgccgcacgccgtgcgcggtcgccaggtgccgcacgatctcggtgccgatgccgccggtcgcgccggtgaccaccaccgtgccgtgttcgcctcccgggccgcgttccgccggaccgtcggtgggccgttcggtgacctgggccagccggggcacgagcacctggccgtcccggacggcgagttgcggttcggcctcggtcagtgcggttcccacggcggcggcgagcagttcggcgtccgcgtcgcggccgccgaggtcggccaggacgaaccgctccgggtgctccgcctgcgccgacagcagcagtccgcgggccgccgcctgcgccgggtcgaccggggtgccgtccccggtggacacggccgcgcgggtgacgaggacgaaccgggccccggccaggcggccgtccgcgagcagttccttgaccagctccagggtgcggtgggtggtgtgccgcatggactcgacggtcgcgccgggttccgtgtccacggacaggacgacgagcccgggcgcggcgccgtgctccgtggagcggccgagggacgcgaggtccgggtgggcctcgacttcggcgccctgggtggcgacgagcgccttggccaggccgtccgcgccgacgacggcccaagggccggccggttcgggagccacggccgccacgggtgtccaggtcaggcgatagagcgagtcaggtccggtgggggcgccggcgggcgtcgtggcgggcgcggtgcccgtccgtacgccgacgcggtccaccgagagcaccggctcgccctccgcgtccgacagcagcacggctacggcgcccgggcccgagcgggtcagccggacccgcagctcggtggcgccggtggcgtaccgggtcaccccggcgaagtggaccggctcgccggcgagttcggtgatcaggtccgtcaggcccgccagcagctcggggtgcagaccgaagcggtcggcgtcgcccgcctcctgctcggtcagcaccagctcggcgaacagctcgtccgcccggcgccacaccgcgtccgcgccgacgggttcggcgtcggcgggcggccaggcggcggggtcgggctcgggccgggcggccgcaccgccgacggtgccgtgcgcgatccgcgtccaggactcgtccccggcgtcaccggagtccgtgggccccacgtggagggtgaagtcccggtcgccgtcctcgtccggcgccgccaccacgagttgcagcggggcgtgcggtccgccgggcagcgcggcggggacgtcgagttcggcgatccggtcgcagccgaggctgccggccgcccacagcaccagatcgaggatgtcgccgcgggacggcggccgttcttcgtcgatgccgggcaggctgccgctgaagagcgacccgccggtaccgggcagcggcacggccgccgtgagcagcgggtgcccggtgcccgccaggcccgcgccggccagcgcctcgacgccgcccgtgggcgcgtccagccagtaccgccggtgctggaacgcgtacgtgggcagttccacccggcgggcgccggtgccgtggaagaacgcgggccagtcgacgcggccggtgcgcacgtgcagcctgccgagcgcggtgagcagggtccgtacctcgtcgcggtcgcggcgctggacggcgatgccggtggcgcccgccccggccgactccttcgccatggcggtcagcacgccgtccgggcccagctccaggaaggtggtcacctcctcgccgagcaggctgtccactccgtccgcgaaccgcacggtcccccgcacctgccgcgcccagtaggcggggtcgcacagctgctcggcggtggccggcttgccggtcacgttggagacgaccggcagttcgggctcggcgaaggtcacctgggccagttcgcgctcgtacgcggcgagcatcggttccatcagcggcgagtggaaggcgtggctcacggtgagccgcttggtgcgcagccccgcctcggcgagccgggcacccgccgccgtgacggcctcctccgtgccggacagcaccatcgaggccgggccgttgacggcggcgacggacacctcgtcgaacgcgtcgccgagcagcgcggacaccacgtcctcggccgcggcgacggacagcatggcgccgccctcgggcagttcctgcatcagccgggcgcgggcggtgaccacccgggccgcgtcggcggtggaccagacgccggccacgtgcgcggcggcgagctcgccgatcgagtggccgagcacggcgtcgggccgtacgccccagtgctccagcagccggaacagcgccacctccacggcgaacagggccggctgtgtgtagagggtctggtcgatcagcgcggcctcgggcgagccgggctcggcgaacacgaccgaggccagcgggcgcggcagatggcggtcgagggcggcgcacagctcgtcgaaggccgacgcgaacgccgggaaggccgcgtacagggcgcggcccatgccggtgcgctgggcgccctggccggtgaagaggaaggcgagccggccctcggcgcgctcctcggcgacggcgcccgcggacaggtccgtgaggccgcggcgcagttcgtccgggtcggcggcgacgagcaccgccgcccggtcgaggacgctgcgggtggtggccagggagtgggcgagatcggtgacgccgtgcccgccctcgtcgaggagggcggtcagccgggcggcctggtcacggagggcgtcctgggtgcgggcggagacgacgacggggacggggcggccggcggtggggacggagacgccgggggcggggcgcccggtgtccgtgtcggcccgctcgtcggtgggctcgtcggcccgctcgtcggtggactcgccggcgggctcgtcgggtgcctcctccagggtgtcgggtgcctcctccaggatcacgtgcgcgttcgtgccgctgatcccgaacgccgagacgcccgcgcggcgcggtgcgccgtcccgtggccactcctgggcccggtcgagcagttccaccgccccggaactccagtcgacgtgcggactcggggcgtccacgtgcagggtgcggggcatcagtccgtgccgcatcgcctgcaccatcttgatgactccggcgacgcccgcggcggcctggctgtgcccgatgttggacttgaccgagcccagccgcagcggccggccggccgggcggtcctggccgtaggtggcgagcagcgcctgtgcctcgatcgggtcgccgagcgtcgtgcccgtaccgtgcgcctcgaccacgtccacggccgaggcgggcagcgccgcgttgaccagcgcctgccggatgacccgctcctgggcggggccgttgggcgcggtgaggccgttggacgcgccgtcctggttcaccgcggagccgcggaccaccgcgaggaccgggtgtccgagccggcgggcgtcggacagccgctccacgagcagcacaccggcgccctcaccgagcgagaacccgtccgcggcggcggcgaacggcttgcagcggccgtcggcggccagtccgcgctgccggctgaacgccacgaaggaggtggggtccggcatgacggtggcaccgcccgcgatcgccaggtcgcactcgccgtcccgcagcgcctgcgcggccaggtgcagcgcgaccagcgaggaggagcaggccgtgtccacggtgagcgcgggtccctggaagccgagcgagtacgagatccgcccggaggcgacgttggcggacgcgctgacgaggtagccctccatgccgtcggtggagccgcgcagccgggtcccgtaggcctggtcggtcagaccgacgtacaccccggtcctgctgccgcgcagcgacctcggggcgatgcccgcgcgttccagcgcctcccaggacgattcgagcagcagccggtgctgcgggtccatggcctgggcctcgcgcggcgagatgccgaagaagcccgggtcgaagtcgcccgcgccgtgcaggaatccgccgtggccgacgtagctggtgcccggccggtcggggtcggcggcgtcgacgagtcggccgagcggccagccgcggtcggtggggaacggggtgatcaggtcggcctcgtcgcgcacggcgcgccacaggtcctcggcggaggcgacgtcgccggggtagcggcaggccatcgcgacgatggcgatcgggtcgtcctggtcgacgcgtacgacggtggcgggttcggccggtacggcggcctcgggggtgaggccgcgggccaggaaatccgccagttcggcgatggtcgggtggtcgaagaccatggtggcgggcagcctgaggccggtcgcggtgctcagccggttgcgcagttcgaccgcggtgagcgagtcgaagccgagctccttgagcgcgcgggcggggtcgacggaccgtgcgtcggcgtggccgagtacggccgcggcctgttcgcgcaccaggtcgcgcagggccgccgtgcgctggggtccggtcagtgcggccagccgttgggcgagcggggaggcggcggtgtcgggcgcggtgtcgtcggtggccggttcggggcgggcctcgggcagttcggtcaggaggcgggtgggccgctcgaaggtgaactgcggggtgaaccgctcccagtcgacgtcgacgagcagcagcgaggactcgccctccgcgagcaccgcggcgagcgcggagacggcgaggtccgggtcgatgaggggcaggcccttgcgggagagggtgtcgaagaccgggtcgtcggccatgccgccgcccgcccagggcgcccaggcgagggacacggtgtgcacgccggccgcgctgcgggcctcggcacgggcgtcgagcacgccgttggcggcggcgtagacgccgtggtcgccggcgccccaggaggcgctgatggaggagaagtagacgacggcgtcgagctgttcggggtccagggccgcttccaggtgggcgatgccggtcaccttggcggccatcgcctcggccaggtcgtcgggcccggcctcggccagcgggccgagcccgccgccgcccgcggtgtgcaccacggcgccgatcgggtcgccgtcgcgctgcgcctcggcgaccatcgcggtcacctgggccggatcggcgaggtcgcaagagagcagggtgaccttgacgccgagcccggtgagttcggtgacgagcgcgtcggcgccgggtgcgagcgggccgcgccgactggtgaggacgaggtgttccgcgccctcgcgggccagccagcgggcgacccgccggccgagcgctccggtgccaccggtcacgagcacggtgccgcgcggccgccagcccgtgccggccgtggcgcgcggggtggcgcgtacgaggcggcggccgaagacgcccgacgggcgcagcgccacctggtcctcgccgtcgaggcccgcgagcaccgccgcgagacggtccgccgtgcggtcgtcgagggggtcgggcagatcgacgaggccgccccaggtgcccgggaactcgagcgcggcgacccggccgagggcccatacggcggcctgttcggggtggaccggtccggcgtcgtcgtcggtggtgacggcgccgtgggtcaggcaccacaggggcgcggtgacccgggcgtcggcgagcgcccgcagcagggcgaggctgagcgccgcgcccgccgggacgacgggccgctccgggtgcggcgaaccgtcgatgccggtcagcgagaccacaccggccggctccgtgccgccgagggcgccgcggagggcggtggccagggtggtggggtcggagccggggtcgacggcgagcaccacgagctgttcggcgcgttcccgcaggagggcggtgacggcggcggtcaccgggtcgtccgcggtgccgccggtggtggcgccggtcaccggctcgtccgtggtcccggtcccggtcaacggttcgtccgtggtcccggtcccggtcggcaccacgaggagccaggtgccgggcagcgtacggcgctccggctcgggcagccggcgccactcgatgcggtagcgccaggactcgacggcggcccgctccttgcggtcgcgccgccaggcggacagggccggtacgagctcgcgcagcggctgttcgtcggcgaggccgagcgtgccggccagggtgggcaggtcctgttggtccacggcctgccagaaccgctcgtcctgcgggtcctgggccaccgccgggcgggccgccggccagtagcgggtgcgctggaaggggtaggcgggcagttccaccggtgtgccgtgccggccggggaaggcgggcgtccagtccacggggacgccgtgcgtccacagttcggccagtgccgtgcgtacgcgcttcagaccgccctcgtcgcggcgcagggtgcccgtcaccaccggttccgctccggccagttcggcggtctcggtgagtgcggcgccgagcaccgggtgcgggctgacctcgacgaagacgtcgtagccctgctcggccagggcggtgacggacggttcgaggagcaccggttcgcgcaggttgcggtaccagtaggcggcgtcgaggccggtggggtcctgccagtcggcggtcacggtggagaagaacgggatctgtcccggccccggccggaccgggccgagggcggtcatgatctcgtcctcgatccgctccacctgcgcggagtgcgaggcgtagtcgacgtcgatgcgccggacccggacgtcctggtcgcgggcgtgggccaccaggtcgtccagggcggcgggtgcgccggagaacaccaccgcggaggggccgttgacggccgcgacggagacctgtccgtcccagcgcggcagccaccgctcggcctcggcgagggggatgccgacggagaccatgccaccctcgccgacgagcgcgcggagcgcctgggcgcgcagcgcgaccacgcgcgccgcgtcgtccagggacagcgccccggccacgcaggccgccgcgatctcgccctgcgagtgtccggccaccgcggcgggcaccacgccgtacgagcgccacagcgccgccagcgacaccatgaccgcgaacagcaccggctggacgacgtccacgcgctccaggggcgtgcccgagcgcacgagctcggtcacggagaagcccgtgtacggcgcgagggcgcgctcgcactcggcccagcgggcggcgaactccggtgcggtgtcgaggagttcggcggccatgccgggccactgtccgccctgcccggggaagacgaagaccgggccgcgtccggcggcccggcgggccacgccggtgaccgtggagccggcgggctccccggcggcgatcgcgcgcagcgcctcggtgagctcgccgtgtcccgcgcccagcgcgacggcccggtgctcgaagtccgaccgggaggtcagcagggcgtgcccgacggcggcggcgggcagctcccgctcggcaagacgggcggccaggcgggcggcctgggcgcgcagcgcctcgggggtgcgggcggagagcacccacgggaggagcggtggggcggtcgccccgggcgcctctccgggggtttcttccggcgcttcttcgggcgcttcctcgggcgtttcttcgggcccctgttccagtacgacatgtgcgttggtgccgctgactccgaacgccgacacccccacccggcgtggcttcccggtgtgcggccactctcggttctcggtgagcagtcccaccgtccccgccgaccagtccacctcgggcgtcggctcgtcgacgtgcagggttcgcggcagtacgccgtgccgcagggcctgcaccatcttgatcacgccgccgaccccggccgcggccccgctgtgcccgatgttggacttgagcgaccccagccacagcggctgtccggccggccggtcccgcccgtaggtggccaggaccgcctgcgcctcgatcgggtcgccgagcgtcgtgcccgtaccgtgcgcctcgacggcgtcgacgtcgtcggcggacagtccggcggcggccagcgcctgccggatcacccgctgctgtgctccgccgttgggcgcggagagcccgttggaggcgccgtcggagttgacggcgctgccccggaccgtggcgaggacgcggtgtccgttgcgccgcgcgtcggagagccgctccacgaccaggacgcccacgccctcggcccagttggtgccgtcggcactcgcggcgaacgccttgcagcggccgtcggcggcgagcccgctctgccgggcgaagtcgacgaacgcgcccggcgtggagatgacggagacgccggtggcgagcgcgaggtcgcactcaccctggtgcagggcgcccacggccatgtgcagggccaccagtgaggaggagcacgccgtgtccacggtgaccgcgggcccgtgcaggccgagggtgtaggcgatccggccggagatgacgctcgcggcggtgccggtggtcaggtatccgtccgcctccggggccccttccagcaccacgccgtagtccgagcccgcggcgccggcgaagactccggtgcggctgccgcgcagggccgccgggtcgaggcccgcgccctccagggcctgccaggacacctccaggagcagtcgctgctgggggtccatcgcggtcgcctcacgcggggagatgccgaagaaggcggcgtcgaagtcggcggcgtcgggcaggaatccgcccttcatggcgaggtccggtgccaggcggcgcagggcgggcaggtcccagccgcggtcggtggggaagtcgccgacgccgtcgcgtccgcagtggacgaggtcccacaggtcctcgggtccgcgtacgccgccggggtagcggcaggccatgccgacgatggcgatcgggtcgtcgtggtcggccgtcggggcgacctcgtcctcgtgctgtcgtacgccggacagttcggccagcagatgtgcggcgaccgcctgcgcggtggggtggtcgaagacgagggtggcgggcagccgcagcccggtctcggcggcgacgcggtcgcggaaccgtacggccgccagggactcgaagccgaggtcgcggaacgggcgtacgggatcgatggcggcgccggaggcgtggccgagcacggcggcggcctgcgcccggaccagttcgaggagttggtgttcccggtcggcggcgggcgcgaggaccacttcggcggtcgggggtgcgggcagggcgcggacctcgggcaggtcggcgacgagcgggcgggggccgcgcccggtgaggacggggtggaacaggctccagtcgacgtcgacgacggcgcagacggggtcgtcggcgtccagggcctcggccagcgcggacacggcgaggtcggcggggagcggcagcaggccggggaccggtgacgcccccgtgtccgccggtgtctcccaggggccccagccgacgcaggtgccggggcggccgtcgagggtgcggcgctcggcgagggactccagggcggcgtgcgcgacggtgtgcacgaggtcctcggcgccgccccaggtgccggcgacggtggacagcagcacgaaggcgtccaggtccgcgtcgtggaacagctcttcgagccgtacgacggtacgcagccggtcctggacggcgcgggccggcccggcggcggtgagggcgtccggcgtggacgggccgtccgggtcgatgccgctgaggtggacgacggcggtcaccgacgccgtctccagcgggcccaggtcccactcggtgacggtgcacggtccgcccgccgcggcgaggacggcggcgtcgggcaggggcgtgccggggcggtgcgccagcaggagcgtgcgagcgccgccgccggagaggtactggaggagttccggtgtgacgcccgcgatgtccccggtgatcaggacggttccgccggtgcgccaggcacgctgccgccgggggcgctgggcgggcagcagcttcctggcgaagacgccgcccggccgtacggcgagttcgtcctggtcgccgggtgcggcgaggacggccgcgagcagccgcagggagcgcgcgtcgaggccggcgggcaggtccaccacgccgccgccggagtgcgggacccggccgagcccccacaggagggctggggcggcaccgggcacggcctcggtgtcgacggagacgggcgcctggtggcgtacactggcggggcgcgcaccccggcctcggagggctgaacgaggggccaggcgggtccagcgggtcgcggactccgcgggaagcgcgagcacgcccgcgacgggccggtcctcgggcagccgcgcgagggcgggagcgaggccgggcccggcggtcagcagcaccgcccgctcccccagggcctcggcgacccgcgctccgtcgccgtgaccgtcaccgtcgctgtcgccgtcgggggcgacgaccagccaggtgccggtcggccgcgcgtcggtgtcgacgtccgggtacggcgtccagccgacccggtagcgcacgcgtccggtccggtcggccggttcggcggtgcgtggtgccgcgggggtggcgggcagccagtagcgctcgcgctggaaggcgtaggtgggcaggtcggtgctggtcgcgccgcgggcggcgagcggggtgtcccagtcgacggccacgccgtgcacgtgcagttcggccagcgcggacaggaacgtggccggctcgggccggtcgtgctggagggtggggacgagggccacctcgcggcccgggtcgccgaggctctcgcgcgccatcgcgatgagcgctccgccgggccccagttcgaggcaggcggtgacgccctgggcgccgagccagcggatgccgtcgtggaagcgcaccgtctcgcggacctggcggacccagtactccggccagttcgcctcgggcgggacgggtgcgccggtcaggttggagaccatggggatgcggggcgggcggtgttcgaggccctcggcgacctcgcgcagccgcgccagcatcggttccatgtggacggagtgcgcggcgtggctgatgggcagcttgcgcgtcttgcgcccgcgctcctcgcaccgggcgcgcacccgctcgacggcgtccgcgtcaccggagaccaccacggaccggggtccgttcaccacggcgatggtcgcccggtcgccgacgtcggcccgcgcgatgagttcggcgagttccgtctcggaggtctcgacggcgaccatcgcgccgtcggtgcgcagggtctgcacgaaccggccgcgcgccgcgacgagggtgcaggcgtcgtccagcgagagcaccccggcgcagtgcgcggcggccagctcgccggtggagtgcccgaggacgaagtcggggacgacaccggcgtgttcgaccagccggaacagcgcgacctccagcgcgaacaccgcggcgagcgcgtacccggtctgctcgatcagcggcagtccgtccacgacgcgcccgtcgaggatgtcgtcgagcgggtgggcgagttgcgggtcgagccggtcgcgcacctcgtcgaaggcgcgggcgaacaccgggaaggtctcgtacagttcccgcccgatgcccgcccgctgcgagccctggccggtgaacaggaaggcgacggggccgctcggcacggtccggccgcgtacgacgcgggggtcgggctcgcccgcgccgagggcggccagggacgtgaggagttcggtgcggtcggcgccgagcacgacggcgcggtgcgcgagccgggcgcggccacgggccagggatcgggcgatgtccagcgggcgccgtccggggtcgccgtcggcgtaccggtgcagccgccgtgcctgggcgcgcagcgcctcctcgctcgcggcggacagcgtccacgggacgggggcggcgggcgaggtgtcggggccgggctcgggtgcgccgtccgcgccgctcgcggcggggtcgtgttcgaggacgacgtgggcgttggtaccgctgatgccgaaggaggagacggccgagcggcgcggccggccggtgctcggccaggtctgttcctccgtcagcagccgtacggcgcccgccgaccagtcgacctggggtgtgggttcgtccacgtgcagggtgcgcggcagcagtccgtgccgcatcgccagcaccatcttgatgactccggccatgccggccgcggcctgcgtgtgaccgatgttcgacttgaccgagccgagccacagcggctcgtccccggcccggtcctggccgtaggtggccagcagggcccccgcctcgatggggtcgccgagccgggttccggtgccgtgcgcctcgaccgcgtcgacctggccgacgctgagctgggcgtcggcgagggccttgcggatgacgcggcgctgggcgggaccgttgggcgcggtcagtccgttggaggcgccgtcctggttgacggccgtgccgcggacggtggccaggacgggcaggccctgttcccgggccgtggacagcggctggagcaggagcacgccgacgccctcgccccagccggtgccgtcggccgccgcggcgaacgccttgcagcggccgtcgcccgccatcccgccctgctccgccatctcggcgaacagctggggttccgccatcaccgcggcaccgccgacgagcgcgaacgagcactcccccgagcgcagggcccgtaccgcgaggtgcagggcgaccagggaggaggagcaggcggtgtcgatggtgatcgcgggcccctggaggccgagcgagtaggcgatccggccggaggcgacgctgctggtggtgccggtcaggaccaggcccttgacctggtcgaggagttcaccgtcgcgcgggccgtacttctggtcggccatgccgacgaacaccccgccgtcggcgccgcgcaccgtggtggggtcgaggcccgcccgctccaggacctcccaggaggtctccaggagcagccgctgctgcgggtccatcgccagcgcctcacgcggcgagatgccgaacagcccggcgtcgaaaccggccgcgtcggcgaggaagccgcccgcgaggcggaagtcgccgcgcaggtggccggtgcgccagccgcggtcggtggggaacccggagatggtgtcggtgccggtgcgcacgcactcccacaggtcctccggggaggcgatgccgcccgggaagcggcagcccatcgagacgacggcgatgggttcggcggcgcccgcctccagttcctgcacccgctgccgggtccgcttcaggtccgcggtgacccgcttgagatagtcgacgagcttgtcgtcatccaccactgcgatcaactccgtatgtgtactaggcgagatcgccgaattcgctgtcgatgaacgcgagcacttccgccgcggaggccgtctggagcgaggagtcctcgccgccgccgtccggcgcggagccggcctcggccttgcgcaggatccggcgcagtcgtgcgacgacttcgtcgtgggcgccgtcgacggggccgagcgcctcgacgcccgcttcgagccgttcgagttcgcccaggacctggagcaccgggtcgtgctccggcggcgcggcgagttccagcagatgcgcggtgagcgccgccggggtggggtggtcgaagaccagggtcgcggggacggtcagggaggtggccgtccgcagccggttgcggagttcgaccgcggtgagcgagtcgaagccgagcgtcttgaacgcctggtcggggtcgatgtcgtcggccgagccgtgaccgaggacgcccgcggtgtgctcgcgcaccagatccagtacgagccggtgccgctcggcgggggacagcgcggccagccgctccgtcagcgtccgcgcgtcaccgggcgtccccgtggtcggggccgtcgtgccggtggccgccacgcgccgcacgcggacgagttcccgcagtacggccgggaccggctggtgcgcggccctggcccgcagtccggccaggtcgagccgggcgggcgtcagcgccgggataccggtgagcagcgcggtgtcgaacagcgcgaggccgtgtgcggagtcgaggggggcgacgccggcccggctcatccgctgccggtcgcgttccgcgaggcgcccggtcatcccgctggcctggtcccacagtccccaggcgaggctgctcgcgggcaggccccgggcgtgccggtgctcggcgagcgcgtcgaggaaggcgttggcggcggcgtagttgccctggccggccgcgccgagtgtggccgaggcggaggagaacaggacgaacatccggggcgccaggtgcgcggtgagccggtgcaggttccaggcgccgcgcaccttggggtgcagtacggcggacagccgccgccggtcgagcgcggacaccaccccgtcgtcggtgacgcccgcggcgtggacgactccggccaggcggtggtgcgcggtgagcggttccaggagccgtcgtacggcgtcctcgtcgccggcgtcgcaggcctcgacccgtacctccgcgcccatctcggcgaggtcggcgcgcagttgccgcacttcgggcgtgtccgtgccccggcgtccggccagggtgacatgacgcagtccgtgctcggtgacgaggtgccgggccagcagggtgcccagggtgccggtgccgccggtgatcaggaccgtctcaccggcctcgaacgggacggacccggcggggacggtcaggaccgccttgccggtgagggtggcctggctcagcacacggaaggcgtccgtcgcgtcccggatgtcccaggtggtgacgggcagcggggtgagcgcgccggactcgaacagctcgacgagatgggcgaggatctcggcgatgcggtccgggcccgcctcccccaggtcgaaggagcggtaccgcacgccggggtggtcggcggcgacgcgttcggggtcgcgggggtcggtcttgcccatctcgacgaaccggccgccgcgcggcatcgcgcgcagcgaggcgtcggtgaactcgcccgcgagcgagttcagtacgacgtcgacgcccgcgccgccggtcgtctcgcgcaccaggtccgcgaagtcgagcgtccgtgaggagccgatgtgcgcgcggtcgagaccggtgtcgagcagggtgctccacttcggttcgctcgcggtgccgaacacctcggcgcccaggtgccgggccagctgcacggcggccatcccgaccccgccggcggcggcgtgcacgagcaccgattcgcccgcgccgagcccggccaggtccaccaggccgtagtaggcggtcaggaaggcgaccggggtggcggcggcggtctcgaaggaccagccgtccggtatccgcgccagcacgcgccggtcggcgaccgcggtgggcccgaacgccccggcgaccatgcccatcacccggtccccgggggccagcccggtgacaccgggtcccgtctccaggacgacgccggcgcactcggtgccgaggtccgcccggccgggatacatgtcgagggcgatcaggacgtcccggaagttcaccccggcggcgtgtacggcgatccgcaccgtgccctcggccaggggcgccgcggcgtccgggcacggcacgagcgccaggtggtccagtgagccgcggccggtgctgtccagccgccacgggccggggccgggcggcac
